United States Patent 11,098,302 (IDENTIFICATION OF POLYNUCLEOTIDES ASSOCIATED WITH A SAMPLE) - sequence listing, part 120

SEQ ID NO: 415512 - DNA, 583 bp, Homo sapiens
  misc_feature: GZ8MTXP01DDPLK.8.43.D10.1.454.CMB.2.raw
  modified_base (219)..(219): a, c, t, g, unknown or other
  modified_base (245)..(245): a, c, t, g, unknown or other
  modified_base (248)..(248): a, c, t, g, unknown or other
  modified_base (252)..(252): a, c, t, g, unknown or other
  modified_base (272)..(272): a, c, t, g, unknown or other
  modified_base (311)..(311): a, c, t, g, unknown or other
  modified_base (347)..(347): a, c, t, g, unknown or other
  modified_base (538)..(538): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactggancagtcacagtgtactatcaatgtcancanaacngacagcacagcactgattanagtacaaacaacagacactcctcgacccctgtcccgtcncacgcctccgtcgtcgggccaaagctcgcctagacncgtgtacgaggttcgcgctacgcccgtaggaggaccgaaggctagtagtacttacgtgtacctgcttactagttacggttggggtcgggtaccggttgggtcggttcgggcgggacggtaccgaaggtccgtcgtacccgtccggtacgtcgaccgacccgaacggccgtcccgtaccccgttcggttccnccgttcgttccgtccccgtcccgtccgttaccgaaccgttcgccg

SEQ ID NO: 415513 - DNA, 721 bp, Homo sapiens
  misc_feature: GZ8MTXP01BR0S0.8.43.D10.1.454.CMB.2.raw
  modified_base (302)..(302): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccagcactggagcagtcacctagtcgttaactataccaaacgtggttaccagcaagaaacctggaacaagcacccgaggaccagtagatttanaacgtaacaaacaacacgaccacctccgtaccggacccctcggcccggttctccgacggtcctcccgtccgttacggggacctaaagccgtcgcccctaagacctaacgtcgtacgagggttcgtacgccaggtcccgtaggaacggacgacggtcgtaggtaagttacttacgtacgccgtagtaccttacgttaaagtttccggttggggggtttcggggttaccggtttcgggggtcgggttaccggggacggggaacggtaaccgtaaacggtcgtaccgggtacccgttaccggtaacgggtccaccgggttacccgtaacggttcccgtcccggtcccccgttacgggttccttaccgtttccgttcccgttaaccccttaccccgtcccgttacccgtaaccgccggaaccg

SEQ ID NO: 415514 - DNA, 594 bp, Homo sapiens
  misc_feature: GZ8MTXP01A5DXS.8.43.D10.1.454.CMB.2.raw
  modified_base (163)..(163): a, c, t, g, unknown or other
  modified_base (284)..(284): a, c, t, g, unknown or other
  modified_base (325)..(325): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggaggacagtcactctcacctgtgcttccagcactggagcagtcacagtgttactatccaaatggttccagcagaacctggacaagcaccaggccactgatttanagtacaaacaacagacactcctcggacccctgcccggttcncaggctccctccgttcggggaccaaagcctggcccctagacnctgtaccagggtgtgcagtccctgacggacgagggctagagttattacgtgtcctgctcgttaagttgtggggttcggggtccgttgggtcggttacgggcggacgggacaaggtctcggacccgtcgtaagggtccaacgccccgaaacggttccgtccggcccccgttcggttcccttccgttcgtcccgttccccaccccgtccttaccggtaacccgccgtcg

SEQ ID NO: 415515 - DNA, 561 bp, Homo sapiens
  misc_feature: GZ8MTXP01CYUAQ.8.43.D10.1.454.CMB.2.raw
  modified_base (312)..(312): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcacccaggccactgatttatagtacaaacaacagacactccngacccctgcccgtctcaggctccctcctcgggccaaagctgccctgacaactgtcaggtgtgcagcctgaggacgaggctgagtattactgctgctctattagtgggggtgggtccgttggggtcggtttcgggcgggagggaccgaagcgtgacccgtccgtacggtcaggcccgaaaggccgtaccggcccccttcgggttccaccgtccttcgttccccacccttcccttccgaaccgcgaaccgg

SEQ ID NO: 415516 - DNA, 648 bp, Homo sapiens
  misc_feature: GZ8MTXP01EBL4I.8.43.D10.1.454.CMB.2.raw
  modified_base (218)..(218): a, c, t, g, unknown or other
  modified_base (290)..(290): a, c, t, g, unknown or other
  modified_base (331)..(331): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcagcactggancagtcaccagtggttactactccaaactggtcagcaagaaacctggaacaagcacccgagccactgtattanagtaacaaacaacagacactacctcgacccctcgcccgttncgacgcctccccgtcgtacgggaccaaagtcctcgccctagactcgtgtaccagggttcgtcgacgacgtccgtagggaggacggaggcgtaggtaagttacgttacctcgtcctgtcttacgttagtttaggttcggggggttcggggtccggtttggggttcgggttacgggacgggacgggtaacgaacggtcgtacggtaccgtccgttagggaaccacggttacccgacggttccgtcccgtcccccggttacggttcccttacgttcctcccggttcccctaccccgtccgttaccgtccgaaccggtcgg

SEQ ID NO: 415517 - DNA, 575 bp, Homo sapiens
  misc_feature: GZ8MTXP01D9N6L.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattatagtaacaaacaacagacactcctcggacccctgccccggttctcacggcctccccgtccgttcggggaccaaagcctacgccctagacaacgtgtcagggtgtgcgacgcctagaggacgaggctgagttattactgcctgctctagttagtggggtcgggtcgttgggtcgttcgggcggagggtaccaaggctcggtaccgtccgtaggtcacggcccgaacggcgtccgccccgttcgttccacctctccgttccccaccctccttacgaaccgcggaaccg

SEQ ID NO: 415518 - DNA, 739 bp, Homo sapiens
  misc_feature: GZ8MTXP01B162S.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcgaggacgccctcactgactgtcgtccccgaggagggacagtcactctcacctgtcgccttccagcacgtggagcagtccaaccgtaggttcggttaactactaccaaacgttcggttaccagacaacgaaacccgtggaacaacgccaacccgaggcccactgtaatttataagtaaaccaaacaacacgacacctccgtccggacccctcgtccccggttctcgacggtccctcccgttccgttccggggacccaaagccgtcgccctagacctcgtgtaccgagggttgtcgacgacgtcccgtggaacgggaccggagggtcgtaggtagttaacttacgtcgccgtcgtcttacttagttacggtggggggttcggggttccggtttgggggtcgggtttcggggacggggtaacggggaccgtaaacggtccgtacgggtacccggtccgttacgggtccaccgggaccctaaacgggcccgtccccggtcccccgttccgggttcccttaaccgttccccggttacccgttccccccgtacccctttaccccgacccggaacccgttccgggtaacccgg

SEQ ID NO: 415519 - DNA, 589 bp, Homo sapiens
  misc_feature: GZ8MTXP01BRWUJ.8.43.D10.1.454.CMB.2.raw
  modified_base (556)..(556): a, c, t, g, unknown or other
  modified_base (584)..(584): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttccagcagaaacctggacaagcacccaggccactgatttatagtaacaaacaacagacactcctcggaccccctgccccggttctcgacggtcctcccgtccgttcgggggacccaaagcctcgcccctagactaacgtgtcgagggtgtgcagccctgaggacgaggctagagtacttacgtcgccgtgctacttagttacgtgggggtcgggtccggtttgggtcggttcgggcgggacggtaccaaggcgtcggtacccgtcgtaggtcacgttcccgaaggttccgtccgccccgttcggttcncgtcctcgtccccgcctccttccgaacncgccg

SEQ ID NO: 415520 - DNA, 671 bp, Homo sapiens
  misc_feature: GZ8MTXP01B6UYM.8.43.D10.1.454.CMB.2.raw
  modified_base (223)..(223): a, c, t, g, unknown or other
  modified_base (279)..(279): a, c, t, g, unknown or other
  modified_base (285)..(285): a, c, t, g, unknown or other
  modified_base (327)..(327): a, c, t, g, unknown or other
  modified_base (366)..(366): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgcttccagcacgtggancagtcacagtgtactataccaaatgtacagcagaactggacaagcaccagccactntattanagtaacaaacaacagacactcctacggacccctgcccggttncacggtcctccctcgtcgggaccaagctcgccctagacnctgtcgaggtcgtcgcgagcccgtaggacggaacggacggctcggagttaacttacgtcgtcccttgacttacttagtttacggttgggggtcgggttccggtttggggttcggttacggggcgggtaacgggaccgtaaacggtccgtacggtaacccgttccgtaacggtccgaaccggaccccgtaaacgggttccccgtcccggtcccccgttcccgggttcccttaccccgtttcccgttacccggttccccccctaaccccgttccccgttaccggtaacccgaaccggtaaccccggg

SEQ ID NO: 415521 - DNA, 557 bp, Homo sapiens
  misc_feature: GZ8MTXP01C4387.8.43.D10.1.454.CMB.2.raw
  modified_base (284)..(284): a, c, t, g, unknown or other
  modified_base (307)..(307): a, c, t, g, unknown or other
  modified_base (360)..(360): a, c, t, g, unknown or other
  modified_base (381)..(381): a, c, t, g, unknown or other
  modified_base (414)..(414): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccagcactgagcagtcacagtgttacatccaaactggttaccagcagaacctggacaagcaccagaccactgatttanagtaacaaacaacagacactccncgaccctgcccgttctcacggctcctcgtcgggaccaaagctcgcctaagacncgtgtcgaggtcgagcagccngaggacgaggctagagtattacgtgccgtgctnttaagttcgtgggggtcggttccgttgggttcgtcggcggacgggacaacggctacgaccgtcctaggtccgacgcccgaacggcctccgtccccttcggttcacttcctacgttcccacccttccgttacgtccaacggccg

SEQ ID NO: 415522 - DNA, 692 bp, Homo sapiens
  misc_feature: GZ8MTXP01DE8KG.8.43.D10.1.454.CMB.2.raw
  modified_base (222)..(222): a, c, t, g, unknown or other
  modified_base (265)..(265): a, c, t, g, unknown or other
  modified_base (283)..(283): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccgaggagggacagtcactctcacctgtgcttccagcacgtggancagtcactagtgtactatcaaactgtacagcagaactggacancaccagccatagtattanagtaacaaacaacagaccactcctcggaccccctcggtcccgtctcacggtcctcccgttccgttcgggggaccctaaaagccgtaccgcccctacgaacctccgtggtcccgaagggttcggtacgccgacggcccgtacgggaacgggaaccgggaagggtccgttaggtaacgggttaactttaccgtcgtacccgtggtaccttacgttaagtttacggtggggggttcggggttccgggtttggggttcggttccggggacgggtaacgggaacgtaacggtcgtacgtaccgtccgttacggtaacgacgaccgtaacggccgtcccggtcccccgttcggccttaaccgttcccgttccgtttcccccaccccgtccgttacccgaaccgttccggaaccgg

SEQ ID NO: 415523 - DNA, 640 bp, Homo sapiens
  misc_feature: GZ8MTXP01B4G3Y.8.43.D10.1.454.CMB.2.raw
  modified_base (281)..(281): a, c, t, g, unknown or other
  modified_base (324)..(324): a, c, t, g, unknown or other
  modified_base (368)..(368): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaactggtcagcagaactggacagcaccagccatgatttanagtaacaaacaacagacactcctcggacccctcgtcccgttcnccgagcctcccgtccgttcggggacctaagctcgccctagaccncgtgccgtaggtgtcgcagtccctggacggacggaggcgtagtagttacttacgtcgtcctgcttacgttaagtttggttcggggggttcggggttcccgggtttggggttcgggttccggggacggggtacgggaaccgaaggtccgttacgggtacccgttccgtacgggtccgaccggacccgtacggttccgtacccggtcccccgttcggttccttacccgttccgttcccgttccccgccctccgttaccgtaaccgccggtccgg

SEQ ID NO: 415524 - DNA, 555 bp, Homo sapiens
  misc_feature: GZ8MTXP01CPRXA.8.43.D10.1.454.CMB.2.raw
  modified_base (220)..(220): a, c, t, g, unknown or other
  modified_base (376)..(376): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgttactataccaaactgtccagcagaaactgacaagcacccaggccactgattatagtaacaaacaacagacactcctcggacccctcgtcccggttctcacggcctccctccgttccggggccaaaacgcgtcgccctcggacncgtgtcaggtgtgcagccctgaggacgaggcgtgagtattactgctgctctattagtggggtggtcgttgggtggttcgggcggacgggacaagcgtcgacgtcgtaggtcacgcgacgcgtccgccccttcggttccaccgtcctcgtcccctacccgtccttccgaacgcgaaccgg

SEQ ID NO: 415525 - DNA, 641 bp, Homo sapiens
  misc_feature: GZ8MTXP01DTGOC.8.43.D10.1.454.CMB.2.raw
  modified_base (219)..(219): a, c, t, g, unknown or other
  modified_base (260)..(260): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactgancagtcacagtgttactatcaaactggttcagcagaactganagcaccagccatgattatagtaacaaacaacagacactccgtcgacccctgcccggttctcacgtcctccctccgttacgggaccaaagctacgccctagactcgtgtcaggtcgtgctaggccctggaggacgaggcgtagaagttattacgtgtcctgcttcgtagtttacggttgggggtcgggttccggtttggggttcggttcggggaccgggtacggggaaccgtaacggtccgtccggtacccggttccgttacgggtccgaacggccccgtaaacgggttccgttcccggtccccccggttacggttcccgttaccgttccccgttccgttcccccgtcccgttccccgttaccgtaaccccgccggtcccgg

SEQ ID NO: 415526 - DNA, 576 bp, Homo sapiens
  misc_feature: GZ8MTXP01CQNUY.8.43.D10.1.454.CMB.2.raw
  modified_base (220)..(220): a, c, t, g, unknown or other
  modified_base (371)..(371): a, c, t, g, unknown or other
  modified_base (399)..(399): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactataccaaactggttccagcagaaacctgacaagcacccaggccactgatttatagtacaaacaacagacactcctcggacccctcgcccggttctcacggcctcctccgttcggggccaaagctgccctgacnctgtcaggtgtcgcacgctgaggacggnggctgagtattactgctgctctattagtgggggtcggtcgttgggtcggttcgggcggacgggtacgaaggtcgtcggtacccgtccgtaggtcacgccgaacggcgtaccgtcccccgttcggttccaccttccttaccgtcccctcccgtcccgttccgtaaccgaaccgcccgg

SEQ ID NO: 415527 - DNA, 594 bp, Homo sapiens
  misc_feature: GZ8MTXP01EHLV2.8.43.D10.1.454.CMB.2.raw
  modified_base (293)..(293): a, c, t, g, unknown or other
  modified_base (575)..(575): a, c, t, g, unknown or other
  modified_base (587)..(587): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagttgttaactataccaaactggttaccagcagaaacctggacaagcaccaggcactgatttanagtaacaaacaacagacactcctcggacccctgtaccccggttctcacggtcctcccgtcccgttcggggacccaaagcctcgcccgtagacctaacgtgtacagggtgtcgcacggtcctggaggacgaggctagaagttattactcggcctgtctacttagtttagtcgggggtcgggtccgtttaggggtcgttcgggacgggtacgggacaaggtcgtcgaccgtcgtaggcacgcccgaacgggctccgccccgttcggttcactcctacgtccccncctccttacgcnccggtcg

SEQ ID NO: 415528 - DNA, 606 bp, Homo sapiens
  misc_feature: GZ8MTXP01CK62M.8.43.D10.1.454.CMB.2.raw
  modified_base (285)..(285): a, c, t, g, unknown or other
  modified_base (362)..(362): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtggttactatccaaactggtcagcagaacctggacaagcaccagccatgattanagtaacaaacacagacactctcgacccctgcccgtctcacgcctccctccgttcggggccaaagcctgccctagacncgtgtcagggtgtcgcacgcctagaggacgaggctgtagtagttactcgtcctgtcttacttagttagtgggggttcggggtccggtttggggtcggttcgggcgggacgggtaccgaaacggtccgtacggacccgttcgtaggtaaccgacggcccgaaacgggttccgtaccggtccccttacgggttccttacgtccgtaccgttcccctaccctccgttaccgtaaccgcgtaacccgg

SEQ ID NO: 415529 - DNA, 676 bp, Homo sapiens
  misc_feature: GZ8MTXP01ADZSD.8.43.D10.1.454.CMB.2.raw
  modified_base (285)..(285): a, c, t, g, unknown or other
  modified_base (287)..(287): a, c, t, g, unknown or other
  modified_base (305)..(305): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttcagcactggagcagtcactagtgttactatacaaactggttaccagcagaacctggacagcaccagcactgattananaacaaacacagacactcncgacccctgcccggttctcacggtcctcccgtccgtcggggaccaaagcctcgccctagacctctgtcgaggttgacgcagccgtaggacggacggaggctaggacgttatacgtcgtcctcgtccttagttacgtttaggtcggggggttcgggtccggttttgggggtcgtttccggggacggggtaacgggtaccgaaacggtcgttaccggtaacccggttcccggtaggtaacccgaacggttacccgtaaaccggggccttccccgggtcccccgttccgggttccccttaccggtttcccttccccggtttaacccccctacccccgttcccgttaacccgtaacccgttaaccggaaccccgg

SEQ ID NO: 415530 - DNA, 589 bp, Homo sapiens
  misc_feature: GZ8MTXP01A0ABY.8.43.D10.1.454.CMB.2.raw
  modified_base (285)..(285): a, c, t, g, unknown or other
  modified_base (306)..(306): a, c, t, g, unknown or other
  modified_base (365)..(365): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttccagcagaactggacaagcacccagccatgattanagacaaacaacagacactccncgacccctgcccggttctcacggctcccctcgttcggggaccaaagcctgccctagacncgtgtcgaggtgtcgcgagccctggaggacggaggctaggagtattactgccctgctctagttagtggggttcgggtccgtttgggtcggttcgggcgggacgggaccaaggctacggtaccgtcgtacggtcgacgttcccggaaacggttcccgtaccgccccgttcgggttccacccttcgtccgttcccctacccttcccgccgaaccgttaacggcccg

SEQ ID NO: 415531 - DNA, 654 bp, Homo sapiens
  misc_feature: GZ8MTXP01BXXP1.8.43.D10.1.454.CMB.2.raw
  modified_base (423)..(423): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgccttccagcacgtggagcagtcaccagtggttaactataccaaactcggttccagcaagaaacctggaacagcacccaggccatgtattatagtaacaaacaacagacactccgtacggacccctcgtcccgttctcgacggcctcccgtccgttcggggacctaaagctcgccctagacctcgtgtcgaggtcgtgcagcccgtaggagggtacgngggctaggtaacgttagttacgcgtcctgtccttacttagtttagtgggggttcgggtccggtttggggtcggtttccgggcgggacgggaccgaaaggcgtacggtacccgtcgtacggtaaccgacggttacccgacggttcccgtaccggtcccccgttcgggttccttaccgttcccgttcccggttcccccgtacccgtcccgttaccgaaccgcccggtaaccgg

SEQ ID NO: 415532 - DNA, 541 bp, Homo sapiens
  misc_feature: GZ8MTXP01DT5MI.8.43.D10.1.454.CMB.2.raw
  modified_base (305)..(305): a, c, t, g, unknown or other
  modified_base (449)..(449): a, c, t, g, unknown or other
  modified_base (521)..(521): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtggttactatcaaactggtccagcagaactgacaagcaccagccactgattatagtaacaaacaacagacactccncggacccctgcccggttctcgacggcctccccgtcgttcggggaccaaagctcgccctagactctgtcagggtgtgcagcctgaggacgaggctagtagtattactgcctgctctattagtggggtcggtcgttgggtgtcggnggagggacgagcgtgccgtccgtgcgtacgccgaacggctaccgccccttcggttcaccgtcctcgtccccncccctcgttccgaacgcgcg

SEQ ID NO: 415533 - DNA, 631 bp, Homo sapiens
  misc_feature: GZ8MTXP01EXXJL.8.43.D10.1.454.CMB.2.raw
  modified_base (378)..(378): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaactggacaagcacccagccactgattatagtaacaaacaacagacactcctcggacccctcggtcccgttctcacggtcctccccgtccgttccggggaccaaagcctcgcccctagaccncgttcgtccgagggtcgtagcgacgccgtaggaggacgaggctgtagtacttactgccctgtctacttagttacgtgggggtcggggtccgttggggtcggttcggggcgggacgggtaaccgaagtcgtacggtacccggtccgtaggtccgtaacgttccccggaacggcccgtcccggtcccccgttccgggttccttacccgttccgtcccgttcccctaccccgttcccttaccgtccgaaccgccgg

SEQ ID NO: 415534 - DNA, 555 bp, Homo sapiens
  misc_feature: GZ8MTXP01EQX60.8.43.D10.1.454.CMB.2.raw
  modified_base (289)..(289): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccagcactggagcagtcaccagtggttactatccaaatggttccagcagaaacctggacaagcacccaggccactgattanagtaacaaacaacagacactcctcggacccctgccccggttctcacggcctccctccgttcggggaccaaagctcgccctagaccncgtgtcgaggtgtcgcagcccgtagaggacgaggctagagtatactgcctgctctattagtgggggtggtccgttgggtcgttcgggcggaggaccaaggctggaccgtcgtaggtcacgcccgaaggccgtcgccccttcggttccacttctccgttccccacctccttcaaccgcgcg

SEQ ID NO: 415535 - DNA, 707 bp, Homo sapiens
  misc_feature: GZ8MTXP01AHRGA.8.43.D10.1.454.CMB.2.raw
  modified_base (305)..(305): a, c, t, g, unknown or other
  modified_base (346)..(346): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggacgccctcactgactgtcgtcccaggagggacagtcactctcacctgtcgcttccagcacgtggagcagtcaccgtagtggttaactactaccaaacgttcggttaccagcaagaaacctggaacaagccaccgaggccactgatttanaagtaacaaacacagacactcctcggacccctgcccgttcncgacgtcctccgtccgtcggggaccaaagtccgtcgcccgtaagacctcgtgtccgagggtcgtcgacgacggtcccgtagggacggtacggaggtcgtaggtaagttacgttacgtcgtccgtcgtacttacgttagtttagggttcgggggttcggggttcccggtttggggttcgggtttacgggcggggtacggaaccgaaggtccggtaccggtacccggttaccggtaggtaaccgaccggacccggtaacggttccccgttaccggtcccccgtttcggttcccttcccggttccctttcccgggttccccccgtcccgtttaccccgccggtaaccgttccgggtaacccggg

SEQ ID NO: 415536 - DNA, 611 bp, Homo sapiens
  misc_feature: GZ8MTXP01A5HVM.8.43.D10.1.454.CMB.2.raw
  modified_base (290)..(290): a, c, t, g, unknown or other
  modified_base (376)..(376): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggaccccctgccccggttctcacggcctcccctccgttcggggccaaagctcgcccctagaccnctgtcagggtgtgcagcctgaggacgaggctgagtattactgcctgctctattagtgggggtgggtccgttggggtcggttcggggcgggtacgggaccgaaaggccgtcggtacccgttccgtacgggtcgacggccccgaaacggcccgtccggtccccccgttccgggttcccacccgttcccgttcccgttcccccgtccccgtcccgttccgaaccgttaaccggcccgg

SEQ ID NO: 415537 - DNA, 620 bp, Homo sapiens
  misc_feature: GZ8MTXP01ASJ46.8.43.D10.1.454.CMB.2.raw
  modified_base (284)..(284): a, c, t, g, unknown or other
  modified_base (329)..(329): a, c, t, g, unknown or other
  modified_base (388)..(388): a, c, t, g, unknown or other
  modified_base (402)..(402): a, c, t, g, unknown or other
  modified_base (419)..(419): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatcaaactggttccagcagaactggacaagcacccaggccactgattanagtaacaaacaacagaacactcctacggacccctgccccggttcnccgacggcctccctccgtcggggacccaaagcgtcgccctagacaacgtgcaggtgtcncagcctgacgacgngcgtagattacgttacngtacctgcttacttagtttagtcgggggttcgggtccgtttggggtcggtttcgggcgggaggtaccgaaggtcgtacggtaccggtccgtacgggtcctaacgaccccggtaaggttcccgtccgtacccccgttcgggttccttaccgttccttcccggttaacccctacccgtccgttaccgcccgttaacgaaccgg

SEQ ID NO: 415538 - DNA, 556 bp, Homo sapiens
  misc_feature: GZ8MTXP01EEK1M.8.43.D10.1.454.CMB.2.raw
  modified_base (285)..(285): a, c, t, g, unknown or other
tcagctcgcgtgtccacgaccggtgctcgatttagactagcagtaagggggcgccaggggtcccttccaatatcagcaccatggcctggacttctctctttctgttcctcctcagttgctgcccagggtccaattctcagactgtggtgactcaggagccctcactgactgtgtccccaggagggacagtcactctcacctgtgcttccagcactggagcagtcaccagtggttactatccaaactggttcagcagaaactggacaagcaccaggcactgattanataacaaacaacagacactctcgacccctgcccggttctcacggcctccctccttcggggaccaaagctcgccctagacaactgtcagggtgtgcagcctgaggacgagctgagtattactgcctgtctctattacgtgggggtgggtccgtttgggtggttcgggcggtacgggacgaagcgtcggaccgtcgtaggtcacgccccgaaggccgtcgcccccgttcggccttaccttctccgttccccaccctccttacgccgaacgccg

SEQ ID NO: 415539 - DNA, 580 bp, Homo sapiens
  misc_feature: GZ8MTXP01BQHHK.8.43.D10.1.454.CMB.2.raw
  modified_base (163)..(163): a, c, t, g, unknown or other
  modified_base (219)..(219): a, c, t, g, unknown or other
  modified_base (272)..(272): a, c, t, g, unknown or other
  modified_base (283)..(283): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggancagtcaccagtggttactatccaaatggttccagcagaacctggacagcaccngccatgattanagtaacaaacaacagacactcctcggacccctcgcccggttctcgacggcctcccgtcgttccggggaccaaagcctcgccctagaccncgtgtcgagggtgtgcgagcctgaggacgaggctgagttattactgcctgcttctagttagtgggggtggtccgtttggggtcgttcgggcgggacgggactaacggtcgtcgtaccgtccgtaggtccgacgcccgtaaggccgtaccgccccgttggttccaccgttcctccgtccccacccgtccgttaccgccgttaacgccgg

SEQ ID NO: 415540 - DNA, 555 bp, Homo sapiens
  misc_feature: GZ8MTXP01D7XZG.8.43.D10.1.454.CMB.2.raw
  modified_base (321)..(321): a, c, t, g, unknown or other
  modified_base (364)..(364): a, c, t, g, unknown or other
  modified_base (376)..(376): a, c, t, g, unknown or other
  modified_base (452)..(452): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatcaaatggtcagcagaactggacaagcaccagccactgattatagtaacaaacaacagacactcgtcgacccctgcccggttcncacggcctccctccgttcggggaccaaagctacgccctagacncgtgtcagggtntcgcacgccgtgagacgaggctagagttactactgctgactcttattaggtggggtcgggtcgttgggtgttcggnggacggacgagcgtacgaccgttcgcggtcacgcccgaaggccgtaccgccccgttcggttccttaccgtcctccgtccccaccctcttccaaccgcgtccgg

SEQ ID NO: 415541 - DNA, 854 bp, Homo sapiens
  misc_feature: GZ8MTXP01CEFD4.8.43.D10.1.454.CMB.2.raw
  modified_base (290)..(290): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggagcagtcaccagtggttactataccaaatggttcagcagaaacctggacaagcacccaggccactgattanagtaacaaacaacagacactcctcgacccctgcccggtctcacggcctccctccgttcgggaccaaagctacgccctagacctcgtgtaccgagggttgtacgcagggcccgtaggacgggacggaacgggtccgtaggtaacggtttaacgtttaaccgttcgggtacccctttacgggtccctttaaccgtttaaggtttttaaacgggtttacggggggggggggttttaccggggggtttcccccggggttttttaggggggtttaccgggggtttttcccggggggaacccggggggtttaaacgggggggaaacccccggtaaaaacggggtcccggtttaaccggggtaaccccggttacccggtttaaacgggggtttaaccccgtaacggggaccccccggtaaaacgggggttccccggtttaacccgggtccccccccggtttcccgggttaccccgttaaccccgtttccccggtttaccccgggttcccccccttaacccccgttcccccggtttacccggaaccccgttaaacccgggtaacccccgggg

SEQ ID NO: 415542 - DNA, 598 bp, Homo sapiens
  misc_feature: GZ8MTXP01CYXBR.8.43.D10.1.454.CMB.2.raw
  modified_base (288)..(288): a, c, t, g, unknown or other
  modified_base (311)..(311): a, c, t, g, unknown or other
  modified_base (367)..(367): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaactgacaagcacccagccactgatttanagtaacaaacaacagacactccncgacccctgcccgtctcacgcctcctccgttcgggaccaaagctcgccctagaccnctgtcgagggtgtcgcagcccgtaggacggacggaggtcgtagtaggttattacgtcgcctcgtcttcttagttagtggggggttcggtcggtttgggtcggttcgggcggacgggacgaacgcgtcgaccgtccgtaggtccgacggaccgacggccgtacccgccccgttccggttccttaccgttcccgttcccgttccccgcccgttcccgccgtaaccgcggccgg

SEQ ID NO: 415543 - DNA, 546 bp, Homo sapiens
  misc_feature: GZ8MTXP01C6L65.8.43.D10.1.454.CMB.2.raw
  modified_base (287)..(287): a, c, t, g, unknown or other
  modified_base (309)..(309): a, c, t, g, unknown or other
  modified_base (358)..(358): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaactggtccagcagaaacctggacaagcaccaggccactgatttanagtacaaacaacagacactccnggacccctgcccgtctcagctcctcttcgggccaaagctgccctagacnctgtcaggtgtgcagcctgaggacgaggctgagtattactgcctgctcttattacgtgggggtcgggtccgtttgggtcggttcgggcggagggaccgaagcgtacgtaccgtccgtaggtcacgcccgaaggccgtaccgccccgttcggttccacgtcctcgttccccaccctccttccgcgcgcg

SEQ ID NO: 415544 - DNA, 652 bp, Homo sapiens
  misc_feature: GZ8MTXP01BF5I2.8.43.D10.1.454.CMB.2.raw
  modified_base (219)..(219): a, c, t, g, unknown or other
  modified_base (291)..(291): a, c, t, g, unknown or other
  modified_base (332)..(332): a, c, t, g, unknown or other
  modified_base (369)..(369): a, c, t, g, unknown or other
  modified_base (378)..(378): a, c, t, g, unknown or other
  modified_base (384)..(384): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggttccagcaagaaacctggacaagcacccaggccactgatttanagtaacaaacaacagaacactcctggacccctgcccgttcncacgctccctcgtcggggccaaagctcgccctagacnctgtaacgnggtcgngacgcgtcggacggacggtacggacgtcgtagtaacgttaacgtcgtccgtcgtctaccgttacgttaagttgggttcggggggttcgggtttcggggtttcgggttcggggttaccggggacggggttaaccggaaccggtacggtcgtaccggtacccgtccggtacgaaccgaccgaccggtacgttccgtccccgtcccggttccgttccttccgttccgttccccgtccccgtccgtcccgttaccgaaccgttcggaaccgg

SEQ ID NO: 415545 - DNA, 651 bp, Homo sapiens
  misc_feature: GZ8MTXP01BB3T2.8.43.D10.1.454.CMB.2.raw
  modified_base (274)..(274): a, c, t, g, unknown or other
  modified_base (286)..(286): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcacagtgtactatcaatgtcagcagaactgacagcaccagccatgattanatacaaacacanacactcctcggacccctgcccggttcacacggtcctcccgtcggtcgggaccaaagcctcgccctagacctcgtgtaccgagggttcgtagcaaggtcccgtagggaacgggacggaggacgtaggtaagttaactttaccgtcgtacctgtacttacgttaagtttacggtgggggttcggggtcggtttggggttcgggttcggacggggtacggaccgaaggccgtacggtacccgtccgtaacggtccacggttacccgaacggccgtacccggtcccccgttccgggttccttacccgttcccgtacccgtttcccccgtaaccccgttccgttaccccggaacgttaacccgggcccgg

SEQ ID NO: 415546 - DNA, 551 bp, Homo sapiens
  misc_feature: GZ8MTXP01ELD7U.8.43.D10.1.454.CMB.2.raw
  modified_base (288)..(288): a, c, t, g, unknown or other
  modified_base (375)..(375): a, c, t, g, unknown or other
  modified_base (487)..(487): a, c, t, g, unknown or other
  modified_base (539)..(539): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctggacaagcacccaggccatgatttanagtacaaacaacagacactcctggaccccctggcccggttctcgacggcctccccgtccttcggggcccaaagctcgcccctagacnctgtcagggtgtgcagcctgaggacgaggctgagttattactgcctgctctattagtgggggtggtccgtttgggtgttcgggcggagggacaagcgtgaccgtcgtggtcngcccaacggcgtcgtcccccttcggttccttacgtctccgtcccgccctccncgtccgcgtccg

SEQ ID NO: 415547 - DNA, 778 bp, Homo sapiens
  misc_feature: GZ8MTXP01EFCCM.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgcttccagcacgtggagcagtcacagtggttactataccaaactggttaccagacaacgaaaccgtacggaacaacgaccacccgacgaccactagtaatttaataagtaaacaaacaacaacgacacctacctaccggtaccccgtccgtcccggttcctccgacgtcctaaaaaaaacccgttccgttacccgggaccgaacgaccgtccgtccccgtacgaccgtcgttcgtaccgtacgggtggtcgacgacgtccgtacggacggacggacggcgtagtagttacgttacgtcgtccgtcgtcttacgttagtttaggttcggggggttcggggttccgggtttcgggggtttcggggttccggggtaccggggtaacggggtaaccggtaaacggtaccggttaccggtacccggttacccggttacgggtaaccggtaccggttaccccggtaacccgggttccccgttccccccggttcccggttcccgttcccgttcccgttccccgttcccccgtaacccccgttccccgtacccggacccgtaaccggttccggtaaccgg

SEQ ID NO: 415548 - DNA, 549 bp, Homo sapiens
  misc_feature: GZ8MTXP01A4SB5.8.43.D10.1.454.CMB.2.raw
  modified_base (289)..(289): a, c, t, g, unknown or other
  modified_base (371)..(371): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctagacaagcacccaggccactgatttanagtaacaaacaacagacactcctggacccctgcccggttctcacggctccctccgttcggggcctaaagctcgccctagacnctgtcaggtgtgcagcctagaggacgaggctgagtattactgctgctctaattgtggggtgggtcgttgggtgttcggcggtaggaccgaagctcgaccgtcgtaggtcagcccaaggttcctcggtccccttcggttccaccgtctcggtccccacccgtccttaccgcgaacgccg

SEQ ID NO: 415549 - DNA, 603 bp, Homo sapiens
  misc_feature: GZ8MTXP01DV7FX.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttaccagcaagaacctggacaagcacccaggaccactgtattatagtaaacaaacaacagacactcctcggacccctcgtcccggttctcgacggtcctcccgtccgttcggggacccaaagctcgccctagactcgtgtccgagggtcgtgcgagccgtagaggacgaggctgagttaattctgtctgctcttaagttcggtgggggttcggtcgtttggggtcggttcgggcgggtacggacgaaggtctcggtaccgtcgtcggctacggcccgaaggttccgtccggtcccccttcgggttccttaccgtccgttccgtccccgtcccgtccgttccgaaccgcgccgg

SEQ ID NO: 415550 - DNA, 555 bp, Homo sapiens
  misc_feature: GZ8MTXP01BFHWC.8.43.D10.1.454.CMB.2.raw
  modified_base (163)..(163): a, c, t, g, unknown or other
  modified_base (272)..(272): a, c, t, g, unknown or other
  modified_base (283)..(283): a, c, t, g, unknown or other
  modified_base (292)..(292): a, c, t, g, unknown or other
  modified_base (322)..(322): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggagcagtcaccagtgttactatccaaactggtccagcagaaactggacaagcaccngccatgattanagtacaaanaacagacactctcggacccctgcccggttncaggcctccctccgttcggggaccaaagctcgccctaagaccaactgtccagggtcgtgacgacgcctaggacggacggaggctagtagttaacgttactgtcctgtctacttattagtgggggtcggtcgttgggtgttcgggcggaggtaccaagcgtcgaccgtcgtaggtcacgccgaacgcgtaccgcccttcggcacctctcgtcccaccgtccttcgtcgaacgcg

SEQ ID NO: 415551 - DNA, 703 bp, Homo sapiens
  misc_feature: GZ8MTXP01D2D88.8.43.D10.1.454.CMB.2.raw
  modified_base (221)..(221): a, c, t, g, unknown or other
  modified_base (315)..(315): a, c, t, g, unknown or other
  modified_base (373)..(373): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcaccagtggttactataccaaactggttaccagcaagaaacctggaacaagcacccaggccatgtattatagaacaaacacagacactcncggacccctcgcccgtctcacgcctccctccgttcgggccaaagtctcgccctgaccncgtgtccgaggtgtcgcacgtccctaggaggacggagtcgtgtaacgttaacgttactcggtcctcgtacttacgttaacgtttacggttcggggggtttcggggttccgggttttcgggggtttcgggtttaccgggggaccgggggttaaacggggaaacccggtaaacggtccgttaccggaacccggtttccgtaacggttaaccgaaccggccccgtaaacgggttccgtccccggttccccccgttccgggttcccttaacccgttcccgttacccgttccccctaaccccgtcccgttacccgaaccgttaaccgaacccggg

SEQ ID NO: 415552 - DNA, 643 bp, Homo sapiens
  misc_feature: GZ8MTXP01D1AT2.8.43.D10.1.454.CMB.2.raw
  modified_base (221)..(221): a, c, t, g, unknown or other
  modified_base (292)..(292): a, c, t, g, unknown or other
  modified_base (385)..(385): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggancagtcaccagttggttactataccaaactgttaccagcaagaacctggacaagcaccagccactgtattanagtaacaaacacagacactctcggacccctcgcccggttctcgacggtcctacccgtccgttacggggaccctaaaggctcgcccctagaccncgttgtcagggttgtacgcgacgccgtgacggacggagcgtagagttacttactcgcctagtctacgttatttagttcgggggtcgggttccgtttgggggttcggttcggggcggtacgggaccaacggtccgttcggtacccggttccgtagggtaaccaccggaccccgtaaacgggttcctcccggtccccgttccgggttccttccgttccgtccgttccccctacccgtcccgttaccgccgttaaccgccg

SEQ ID NO: 415553 - DNA, 629 bp, Homo sapiens
  misc_feature: GZ8MTXP01ECT4B.8.43.D10.1.454.CMB.2.raw
  modified_base (286)..(286): a, c, t, g, unknown or other
  modified_base (369)..(369): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcagaactggacaagcaccagccatgattanagtaaacaaacaacagacactcctcgacccctcgcccggttctcacggcctccctcgtcgggaccaaagctcgccctagaccncgtgtcgagggtgtgacagcctaggacggacggaggtcgtaggagttacttactcgcctgtcttacttagttagtcggggggttcgggtccggtttggggttcggttcggggacgggtaacgggaccgtaacggtccgtcggtacccgttccgtagggtccacggttacccgacggttccgtacccggtcccccgttcgggttccttaccgttccgttcccgttccccgtcccgtcccgttccgaacccgttccggccgg

SEQ ID NO: 415554 - DNA, 623 bp, Homo sapiens
  misc_feature: GZ8MTXP01D7LSL.8.43.D10.1.454.CMB.2.raw
  modified_base (282)..(282): a, c, t, g, unknown or other
  modified_base (365)..(365): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaatggttccagcagaacctgacaagcaccagccactgattanagtaacaaacaacagacaactcctggaccccctgcccggttctcgacggcctccctcctcggggccaaagctcgccctagacncgtgtcaggtgtgcagcctagagacgaggctgtacgtattactgcctgctctattacgtgggggttcggccgtttgggtcggttcgggcgggaagggacccgaaaggccgtacggacccgttccgtacggtaaccgtacggcccgtaaacgggttcctccggtccccccttcgggttccccttaaccttccccgttaccggtttccccccgaaccccctttcccgttacccggtaaccccgaaccgggtaaccccggg

SEQ ID NO: 415555 - DNA, 667 bp, Homo sapiens
  misc_feature: GZ8MTXP01ESS4J.8.43.D10.1.454.CMB.2.raw
  modified_base (221)..(221): a, c, t, g, unknown or other
  modified_base (311)..(311): a, c, t, g, unknown or other
  modified_base (355)..(355): a, c, t, g, unknown or other
  modified_base (402)..(402): a, c, t, g, unknown or other
  modified_base (445)..(445): a, c, t, g, unknown or other
  modified_base (631)..(631): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcacctagtgttactactaccaaacgttcggtaccagtaccaagaaaaccctaggaacaaacgccaacccaggcccactgtatttanagtaaacaaacaacagacactccgtcggacccctcgcccgttcncgacggcctcccgtcgttaccggggacctaaagcctcgccctagacncgtgtcgagggtgtcgacgacgtcccgtaggacggacgacggntagtagttaactacgtcgcctgtccttattagttagtgggggttcgggttccggttggggttcggtacgggtacggaggaccgaacggtcgtcgacccgttccgtacggtccgacggacccgtaacggcccgtcccggacccccgttcgggttacttacccgttcccgttcccggtttaacccccnccccgttccccgttaccgtccggaaccggtcccggg

SEQ ID NO: 415556 - DNA, 603 bp, Homo sapiens
  misc_feature: GZ8MTXP01EE62C.8.43.D10.1.454.CMB.2.raw
  modified_base (287)..(287): a, c, t, g, unknown or other
  modified_base (372)..(372): a, c, t, g, unknown or other
  modified_base (385)..(385): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactgttccagcagaaactggacaagcaccaggccactgattanagtaacaaacaacagacactcctcggacccctgcccgttctcacggtcctcccgtccgttcgggaccaaagctacgccctagacncgtcgtcagggtntgcagccctaggaggacggaggcgtgagtacttacgtcgcctgctacttattagtgggggtggtccggttgggtcggttcgggcggacgggaccgaacggtcgtaccggtaccgtccgtaggtccgaacgcccgaacggccgtccgcccccgttcgggttccttccgttccgttccgttcccccgccccgtcccgttaccgaaccgttaaccggccgg

SEQ ID NO: 415557 - DNA, 572 bp, Homo sapiens
  misc_feature: GZ8MTXP01CDLE6.8.43.D10.1.454.CMB.2.raw
  modified_base (405)..(405): a, c, t, g, unknown or other
  modified_base (476)..(476): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccggtcaattctcagactgtggtgactcaggagccctcactgactgtgtcccccaggagggacagtcactctcacctgtgcttccagcactggagcagtcaccagtggttactactccaaactggttccagcagaaacctggacaagcaccaggccactgatttatagtacaaaacacagacactcctggacccctcgcccggttctcgacgctcccctcgttggggccccaaagctcgccctgaaccactgtctaggtgtcgcaggcctgggacggacgngggactggattaacttactcgcctgcttacttattagttgggtgggggtccgttggggttcggttccgggnggtacggacaagcgtcgtaccgtcgtagtcgaacgaccaggccttcggccccctggcccacttccgtcttccccaaccttccgtcgcaaccgcgcg

SEQ ID NO: 415558 - DNA, 655 bp, Homo sapiens
  misc_feature: GZ8MTXP01AP92P.8.43.D10.1.454.CMB.2.raw
  modified_base (217)..(217): a, c, t, g, unknown or other
  modified_base (295)..(295): a, c, t, g, unknown or other
  modified_base (427)..(427): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtcccaggaggacagtcactctcacctgtgcttcagcactggancagtcacctagtgttactataccaaactggttaccagacaagaaacctggacaagccaccaggccactgtaatttaanagtaaacaaacaacagaccactccgacgtacccctgcccggttctcgacggtcctcccgtccgtcggggaccaagcgtcgccctaagacctcgtgtacgtaggtgtcacgacgtcccgtaggacggaccggnggacgtgtaagttacttacgtcgccgttgcttacgtaagtttaggttcggggggtttcggggttccggttttgggggttcggtttacgggggacgggtacgggtaccgtaaggtccgtacgggtacccgtcgttaacggcacggttcccgacggttcccgtccgtcccccggttcgttccttacccgttcctacccgttccccacctcccgttaccgaaccgccgcgg

SEQ ID NO: 415559 - DNA, 663 bp, Homo sapiens
  misc_feature: GZ8MTXP01B44OL.8.43.D10.1.454.CMB.2.raw
  modified_base (254)..(254): a, c, t, g, unknown or other
  modified_base (276)..(276): a, c, t, g, unknown or other
  modified_base (317)..(317): a, c, t, g, unknown or other
  modified_base (348)..(348): a, c, t, g, unknown or other
tcagctcgcgtgtccacgaccggtgctcgatttagactagcagtaaggggggcgccaggggtcccttccaatatcagcaccatggcctggactcctctctttctgttcctcctcatttgctgcccagggtccaattctcagactgtggtgactcaggagtcctcactgactgtgtccccaggagggacagtcactctcacctgtgcttccagcactggagcagtcacagtgtactatcaatggtcagcagaacnggacagcaccagcactgattanagtacaaacaacagacactcctcggacccctcgcccgttcncacggtcctccctcgtcgggaccaaagctcnccctagaccaacgtgtcgagggtcgtcgcgacgcccgtaggacggacggaggctagtaagttaacttacgtgtcccgtgtccttagttagtttacggttcggggggttcggggttcccgggtttggggtccgggtttacggggacggggtaaccgggaccgtaaacggtccgtacggtacccggtaccgttacgggtcgaaccgacccggtaacggttccgtcccggtcccccgttacgggttccccttaccggttcccttccccggttaaccccctaaccccgttcccgacccgtaacccgaacggtaacccgg

SEQ ID NO: 415560 - DNA, 600 bp, Homo sapiens
  misc_feature: GZ8MTXP01A0SCD.8.43.D10.1.454.CMB.2.raw
  modified_base (219)..(219): a, c, t, g, unknown or other
  modified_base (288)..(288): a, c, t, g, unknown or other
  modified_base (376)..(376): a, c, t, g, unknown or other
  modified_base (589)..(589): a, c, t, g, unknown or other
  modified_base (592)..(592): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgttactatccaaactggttccagcagaaacctggacaagcacccagccactgatttanagtaacaaacaacagacactcctcggacccctgccccggttctcacggcctccccgtccgttccggggaccaaagcctcgccctgacnctgtcgaggtgtcgcagtcccgtagacggaccggaaggtcgtaggtaagttattacgtcgcccttgcttcttagttacgtgggggttcgggtcccgtttggggtcggtttaccggggcgggacgggtaacccgaagtccgtcggaacccgtccgtagggtcacgcccgaacggcctccgtccccgttcggcttacctctcgtcccacccgtcnccncgttcgcg

SEQ ID NO: 415561 - DNA, 633 bp, Homo sapiens
  misc_feature: GZ8MTXP01CUHPO.8.43.D10.1.454.CMB.2.raw
  modified_base (197)..(197): a, c, t, g, unknown or other
  modified_base (254)..(254): a, c, t, g, unknown or other
  modified_base (257)..(257): a, c, t, g, unknown or other
  modified_base (274)..(274): a, c, t, g, unknown or other
  modified_base (276)..(276): a, c, t, g, unknown or other
  modified_base (308)..(308): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactcncacctgtgcttccagcactggagcagtcacagtgtactatcaactgtcagcagaacnganagcaccagcatgattananaacaaacacagacactctcgaccctgcccgtncagcctcctcgtcgggaccaagctcgccctaagacaacgtgtcgaggtcgtgctacggcctagacggacggagtcgtagaaggttaattaccgtcggtcctgacttacgtagtttagttcggggggtcggggttccggttgggttcgggtttcgggacgggtacggggaacctaaaggtcgtacggtacccggttcgttaacgggcgtaaccggcccgtaaacggcccgttccggtcccccgttcgggttcccaacccggtttcccttaaccccggttcccccttaacccccgtaccgttccccggtaaccgaaccggtcccggg

SEQ ID NO: 415562 - DNA, 546 bp, Homo sapiens
  misc_feature: GZ8MTXP01BDF8X.8.43.D10.1.454.CMB.2.raw
  modified_base (219)..(219): a, c, t, g, unknown or other
  modified_base (287)..(287): a, c, t, g, unknown or other
  modified_base (370)..(370): a, c, t, g, unknown or other
  modified_base (475)..(475): a, c, t, g, unknown or other
  modified_base (526)..(526): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaatggttccagcagaacctggacaagcacccaggccactgattanagtacaaacaacagacactcctcggacccctcgcccggttctcacggcctccctccgttcggggaccaaagctcgccctgacnctgtcaggtcgtgcagcctgagacgagctgagtatactgctagctactattagtggggtcggtcgttgggtcgttcggcggaggaccgaagctcggacccgtcgnggtcacgcccgaaggccgtacgcccccttcggttccacctctccgtccccnccctccttcgaaccgcgccg

SEQ ID NO: 415563 - DNA, 734 bp, Homo sapiens
  misc_feature: GZ8MTXP01CWM5G.8.43.D10.1.454.CMB.2.raw
  modified_base (281)..(281): a, c, t, g, unknown or other
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatcaactggtccagcagaactggacagcacccagccactgatttanagtaacaaacaacagacactcctacggacccctcgtcccggttctcacggcctccctcgttccgggaccaaagctcgcccctagaccncgtgtccgagggtgtcgctagcccgtagaggacggacggtcgtgtagtagttaccgtgtcccgtggtcttcgttaagtttaggttcggggggttggggttccccgtttgggggttcgggtttccggggacggggaccgggggtaacccgtaaacgggtccgttaccgggtacccggttcccgtaacggggttaacccgtaacccgggaccccggttaaacgggccccgttaaccccgggtcccccccccgtttcccggggttccccgttaccccggtttccccggtttcccccgggtttccccccggtccccccccgttcccccggtttacccggtaaacccccgttcccggggtaaccccgggg

SEQ ID NO: 415564 - DNA, 576 bp, Homo sapiens
  misc_feature: GZ8MTXP01AVDC6.8.43.D10.1.454.CMB.2.raw
  modified_base (220)..(220): a, c, t, g, unknown or other
  modified_base (264)..(264): a, c, t, g, unknown or other
  modified_base (288)..(288): a, c, t, g, unknown or other
  modified_base (328)..(328): a, c, t, g, unknown or other
  modified_base (510)..(510): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggttccagcagaaaccnggacaagcaccagccactgattanagtaacaaacacagacactcctcgacccctgcccggttcncgacgcctcccgtccgttcgggccaaagctacgccctgactcgtgtcgaggtcgtcgaccgacgtcccgtaggacggacggaggtcgtagagttattacgtcgcctgctcgttaattagtggggtcggggtcgttggggtcgttcgggcggtacggacaacgcgtacgaccgtcgtaggtcncgcccgaggcctccggccccttcggcttaccgtcgttccgtccccacccgtccacgtcgcgaacgg

SEQ ID NO: 415565 - DNA, 761 bp, Homo sapiens
  misc_feature: GZ8MTXP01DPUJS.8.43.D10.1.454.CMB.2.raw
  modified_base (296)..(296): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtcccgaggaggacagtcactctcacctgtgcttccagcacgtggagcagtcacgtagtgttactataccaaacgtcgtacagcaagaaacctgaacaagccaccaggccactgtatttanaacgtaaacaaacaacagacctactccgtcgacccctcgcccgttctcgacgtcctcccgtcgttcgggaccaaacgctcgccctagacctaacgtcgtcgtagggtcgtcgacgacggtcgtagggaacgggaacggacgggtccgttaggtaaggttaacgtttacgtcggtcccgttcgtaccgttacgtttaagtttacgggtttcgggggggttccggggtttccggggttttcgggggttacgggtttccgggggaaccgggggtaaccggggtaaccggtaaacggtccggttaccgggttaacccggttacccgttacgggttaaccgaaccggaccccggtaaacggttccccgttacccggtccccccggttccgggttacccttcccgtttcccgttaccccggttccccctaaccccgtttccccgttacccgtaacccgcccggtaaccggg

SEQ ID NO: 415566 - DNA, 609 bp, Homo sapiens
  misc_feature: GZ8MTXP01E1B0K.8.43.D10.1.454.CMB.2.raw
  modified_base (164)..(164): a, c, t, g, unknown or other
  modified_base (219)..(219): a, c, t, g, unknown or other
  modified_base (227)..(227): a, c, t, g, unknown or other
  modified_base (281)..(281): a, c, t, g, unknown or other
  modified_base (327)..(327): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtgtccccaggaggacagtcactctcacctgtgcttccagcactggancagtcacngtgttactatccaaatgtccagcagaactgacaagcacccagccactgatttanataacaaacaacagacacctccacggaccccctggccccggtttcncgacggtcctacccgtccgttccggggaccaaacgctcgccctaacgacctctcgcgagggtgtacgacacgtcccgtaggaacggacggaggctaggtaagttacttacgtcgcctgtaccttattagttacgtgggggtcggtccggtttggggtacgttcggggcggacgggaccaaggtcgtcgtaccggtctggcacgttacccgagggcctcccggccccgttacggttcccttaccttccgtccttccccggcccttccgacaacgttcgaaccg

SEQ ID NO: 415567 - DNA, 615 bp, Homo sapiens
  misc_feature: GZ8MTXP01BAH3A.8.43.D10.1.454.CMB.2.raw
  modified_base (219)..(219): a, c, t, g, unknown or other
  modified_base (288)..(288): a, c, t, g, unknown or other
  modified_base (378)..(378): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtggttactatccaaatggttccagcagaaacctggacaagcacccaggccactgatttanagtaacaaacaacagacactcctcggacccctcgcccggttctcgacggtcctcccgtccgttcggggaccaaagctacgccctagaccnctgtccagggtcgtgcgagcctgaggacgaggctagaggttattacgtgcctagcttcttagttacgtgggggtcgggtccgttgggtcggttcgggcgggacgggtacgaaggtctcggacccgttccgtaagggtccgacggaccccgtaaggcccgttccggccccccgttcgggttccttaccttcccgttccgttccccgtcccctcccgttccgtaaccgaaccggcccgg

SEQ ID NO: 415568 - DNA, 700 bp, Homo sapiens
  misc_feature: GZ8MTXP01EZVVI.8.43.D10.1.454.CMB.2.raw
  modified_base (220)..(220): a, c, t, g, unknown or other
  modified_base (291)..(291): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaattggttccagcagaaacctggacaagcacccaggccactgatttanagtacaaacaacagaccactcctcgggaccccctgccccggttctcacggtcctcccctccgttcgggggacccctaaaggcccttggcccccttaggacctaaccgttgtccgtaggggttcgtggcccaaggtccccgtaggacggggaccggaagggcgttggaagttaacttactggcccttgccttcttaagttacgtggggggtgggtcccggtttgggggtcggtttccgggggccgggacgggggaccccaaagggtcccgtacgggaaccccggttccgtaacgggtaacccgaacgggccccgaaagggttccctccggtcccccccgttacgggttcccaccgttccccgtcggtttcccccgccccgttccccgttccgtaacccgaaccggccggg

SEQ ID NO: 415569 - DNA, 641 bp, Homo sapiens
  misc_feature: GZ8MTXP01B4RM0.8.43.D10.1.454.CMB.2.raw
  modified_base (297)..(297): a, c, t, g, unknown or other
  modified_base (343)..(343): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccgaggagggacagtcactctcacctgtgccttccagcactggagcagtcacctagtgttaactactaccaaactcggtaccagcaagaaacctgacaagcacccagccatgtattanaagtaaacaaacaacagaccactcctcgacccctcgtccccgttcncgaccgtcctcccgtcgtaccggggaccaaagtcctacgccctaagacctcgtgtcgaggtgtacgcgacgtccgtaggacggtacggacggtcgtagtagttacgttacgtcgtctcgtcgttacttagtttaggttcgggggttcgggttccggtttgggttcggttcgggacgggtacggaccgaggtcgtacgccgtcgtacggtcacgcccgacgccgtacccgtccccgttcggttcccttaccgttccgtccccggttcccctcccgtccgttccgaacccgttcggccgg

SEQ ID NO: 415570 - DNA, 591 bp, Homo sapiens
  misc_feature: GZ8MTXP01BVIEQ.8.43.D10.1.454.CMB.2.raw
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtaacaaacaacagacactcctggacccctgcccgttctcacggcctcccgtcttcggggccaaagctcgccctgacnctgtcgaggtgtgcagcctgacggacgaggcgtgacgttattactgcctgctactattagtgggggttgggtccgtttggggtcggttcgggcggtacgggaccgaagcgtcggtacccgtccgtaggtcacggcccgtaacgggccgtcccggtcccccgttcggttcccgttaccttccgtcccgttccccacccctccgttaccgtaaccgaaccgccg

SEQ ID NO: 415571 - DNA, 866 bp, Homo sapiens
  misc_feature: GZ8MTXP01D604A.8.43.D10.1.454.CMB.2.raw
  modified_base (225)..(225): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcagcagccctcactgactgtcgtccccgaggagggacagtccactctcacctgtcgcttccagcacgtggancagtccaccgtagttcggttaactactaccgtaaacgttcggttaccacgacaaacgaaacccgtaggaacaaacgacccaaccccgaaggccctacgtagtaattttaacgtaaacgtaaaccaaaaccgaaacacgaacctaaccgttaccccgtaccggaacccccccgttcggtccccccgggtttccttacccgtaacccggtcccttccccccgtttacccccgggtttccgggggaaccctaaaacggtcccgtaccggtaccccccgttagaacccgtaacgttccggtacgtacgggttgtaccggacgtacggacccgtagggaacgggacgggacggtccgtacggttaaagttacgttaacgtccgccgttggaccctttacgtagtttaacgggggttcggggttccgggggttccggttttcgggggttcgggttccggggaccggggaacggggtaaccgtaacggtccggttaccgtaccccgggtacgttaaccggggtaccgttaccgggaccccgaaacgggtccccgtccccggttacccccgttccggggttccctcccgttcccgtttccccggttcccccgtacccccgttccgtaacccggaacccgtaaccccggg

SEQ ID NO: 415572 - DNA, 677 bp, Homo sapiens
  misc_feature: GZ8MTXP01D4K6M.8.43.D10.1.454.CMB.2.raw
  modified_base (281)..(281): a, c, t, g, unknown or other
  modified_base (287)..(287): a, c, t, g, unknown or other
  modified_base (303)..(303): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatcaaatggtccagcagaactggacaagcaccagccactgattanagtaanaaacaacagacactcncgacccctgcccgttctcacgtcctccctccgttcggggaccaaaggctacgccctacgactcgtgtcagggttgtcgacgaaggcccgtaggaggaacggacggtacgtagaaggttaacttactcgtcccgtgaccttgttaacgtttagttcggggggtcggggtccggtttgggggttcgggtttccggggcgggtaacggggtacccgaaaggtccgtacggacccggttaccgtacgggttaacgaacgttacccccggaaaggttcccgttccggtcccccccgttcgggttacccttacccgttccttaacccggttccccctaaccccttccccgttccggtaacccggttcccggtaacccggg

SEQ ID NO: 415573 - DNA, 656 bp, Homo sapiens
  misc_feature: GZ8MTXP01EJ9HR.8.43.D10.1.454.CMB.2.raw
  modified_base (287)..(287): a, c, t, g, unknown or other
  modified_base (306)..(306): a, c, t, g, unknown or other
  modified_base (331)..(331): a, c, t, g, unknown or other
  modified_base (377)..(377): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactataccaaactggtccagcagaaacctgacaagcacccagccactgattanagtaacaaacaacagaacnctcctcggacccctgccccggttcncacggcctccctccgttcggggaccaaaggctacgcccctagaccncgttgtacgaggtgtgacgagcccgtaggacggacggagggcctggtacgttaattacgtcgtccgtgccttcttagtttaggttggggggttcggggtcccgtttggggttcgggttacggggtaccgggacggggtaccgaaaggtccgtacgtaacccggtcgtaacggtcgacggacccgaacggttccgtccggtacccccgttccgggttccttacccgttcccttacggttccccctaaccccgtccgttacccgtaaccgaaccgtccggg

SEQ ID NO: 415574 - DNA, 582 bp, Homo sapiens
  misc_feature: GZ8MTXP01EAH4C.8.43.D10.1.454.CMB.2.raw
  modified_base (285)..(285): a, c, t, g, unknown or other
  modified_base (298)..(298): a, c, t, g, unknown or other
  modified_base (324)..(324): a, c, t, g, unknown or other
  modified_base (529)..(529): a, c, t, g, unknown or other
  modified_base (540)..(540): a, c, t, g, unknown or other
  modified_base (566)..(566): a, c, t, g, unknown or other
  modified_base (572)..(572): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccgaggagggacagtcactctcacctgtgcttccagcactggagcagtcacagtcgtactatacaaactgtacagcaagaactggacagccaccgagccatgtattanagaacaaacacanactactcgtcgacccctgtcccgtcncacggtcctccgtcgtcgggaccaagcctcgaccctaacgactcgtggtccgaggtcgtacgcgagggccgtagggacggtacggacggtcgtagtagttaacgttcgtcgtaccgttgcttacgttagttacggtggggggtcgggttacggttgggtcggtcgggtcgggacggacgtacgtcgtccgtacgtcgtgtaaccncgttacgcgcnccggccttcgcttctccgtcgtcccnccgtcncgaacgcgcg

SEQ ID NO: 415575 - DNA, 683 bp, Homo sapiens
  misc_feature: GZ8MTXP01BH37U.8.43.D10.1.454.CMB.2.raw
  modified_base (220)..(220): a, c, t, g, unknown or other
  modified_base (287)..(287): a, c, t, g, unknown or other
  modified_base (289)..(289): a, c, t, g, unknown or other
  modified_base (296)..(296): a, c, t, g, unknown or other
  modified_base (300)..(300): a, c, t, g, unknown or other
  modified_base (324)..(324): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactctcacctgtgcttccagcactggancagtcacagtggttactactaccaacgtggtaccagcaagaaactgacaagcaccagcatgtattananaacaaanacanacactcctcgaccctcgcccgttncgacgcctcccgtcgtccgggacctaagcctacgccctagactcgtcgtcgaggtcgtgcgacgtccgtaggacggacggaggtacgtaggtaagttacttacgtcgtccgttgtaccttacttaagtttcgggtcggggggttcggggttccggggtttcgggggttcgggtttaccgggggacgggtaaccggggaaccgtaaacgggtccgttacccgggtaacccggttcccggtaacgggtaacccgtaacggaccccggtacggttcccgtaccccggcccccgttacggttcccttaccgttcccggtcccttcccccgacccgtcccgttacccgtccgaaccggaaccgg

SEQ ID NO: 415576 - DNA, 609 bp, Homo sapiens
  misc_feature: GZ8MTXP01CDHLR.8.43.D10.1.454.CMB.2.raw
  modified_base (221)..(221): a, c, t, g, unknown or other
  modified_base (266)..(266): a, c, t, g, unknown or other
  modified_base (282)..(282): a, c, t, g, unknown or other
  modified_base (322)..(322): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggancagtcaccagtgttactatccaaatggttcagcagaactggacancaccagcactgattanatataaacaacagacactacctcggacccctgccccgttntccgacgtcctccctcgtccgggaccaaagctcgccctagacctctgtcgaggtgtgcagcccgtgaggaccggaggctagtagtattacgtcgactgtcttactagttacgttgggggtcgggtccgtttggggtcggttcgggcggtacgggaccgtaaagtccgtagacccgttacgtagggtccaacggcccgaaacggttccgtcccggtcccccgttacggttccgttacccgttcccgtccgttcccccgaccccttccgacccgtccgaaccggtccgg

SEQ ID NO: 415577 - DNA, 622 bp, Homo sapiens
  misc_feature: GZ8MTXP01AKHCI.8.43.D10.1.454.CMB.2.raw
  modified_base (219)..(219): a, c, t, g, unknown or other
  modified_base (254)..(254): a, c, t, g, unknown or other
  modified_base (276)..(276): a, c, t, g, unknown or other
  modified_base (286)..(286): a, c, t, g, unknown or other
  modified_base (371)..(371): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgttactatccaatgtcagcagaacngacagcaccagccactgattanagtaacaaanaacagacactcctcggacccctgcccggttctcacggtctcccgtcgtcgggcccaaagctcgccctagactctgtcgagggtgngcacgcccgtgacggacgaggcgtgagttatacgtgcctgctcttagttgtagggggtcgggtccggtttggggttcggttcggggcgggtacgggaccgtaacggtccgtacggtacccgttaccgtacgggtccgaaccggacccggaacggcccgttcccggccccccgttccgggttcccttaccgttcccgttcccgttcccccgtaccccgttccccgttaccgaaccgttaaccggaacccggg

SEQ ID NO: 415578 - DNA, 577 bp, Homo sapiens
  misc_feature: GZ8MTXP01EKU5N.8.43.D10.1.454.CMB.2.raw
  modified_base (220)..(220): a, c, t, g, unknown or other
  modified_base (283)..(283): a, c, t, g, unknown or other
  modified_base (306)..(306): a, c, t, g, unknown or other
  modified_base (370)..(370): a, c, t, g, unknown or other
  modified_base (421)..(421): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgttactatccaatggtcagcagaacctggacaagcaccaggccactgatttanagtaacaaacaacagacactccncggacccctgcccggttctcgacggcctcccgtccgttcggggaccaaagctacgccctagacnctgtcagggtgtgcagcctgaggacgaggctgagttattacgtgcctgctnttattagtgggggtcggtcgttgggtcggttcgggcgggacggacgacgtcgtacggtacccgtcgtcggtcgaccgaccgtacgccgtcccgtccccgttcggttccttacgttccgtccgttccccaccctccgttaccgtaaccgcgaaccgg

SEQ ID NO: 415579 - DNA, 585 bp, Homo sapiens
  misc_feature: GZ8MTXP01EN09J.8.43.D10.1.454.CMB.2.raw
  modified_base (286)..(286): a, c, t, g, unknown or other
  modified_base (331)..(331): a, c, t, g, unknown or other
  modified_base (380)..(380): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaacctggacaagcaccaggccatgatttanagtaacaaacaacagacaactcctaggacccctgccccggtttcncgacggcctcccgtccgttcggggaccctaaagctcgcccctaacgacnccgtgtcgagggttgtacggcagccgtagaggacggaggctagagttacttacgtgtcctgctacttagttagtgggggtggtcgttgggtcgtcggcggtaggacgagcgtcgaccgtcgtagtcgcgacccgaggccgtccggccccgttcggttccaccttcgttccgtcccctacccgtccttccggaaccttcggaaccg

SEQ ID NO: 415580 - DNA, 637 bp, Homo sapiens
  misc_feature: GZ8MTXP01AP8CB.8.43.D10.1.454.CMB.2.raw
  modified_base (302)..(302): a, c, t, g, unknown or other
  modified_base (326)..(326): a, c, t, g, unknown or other
  modified_base (341)..(341): a, c, t, g, unknown or other
  modified_base (375)..(375): a, c, t, g, unknown or other
  modified_base (387)..(387): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccaggaggacagtcactctcacctgtgcttccagcactggagcagtccaccagttcggttaactataccaaacgtggttaccagcaacgaaacctggacaacgcacccgagccactgatttanaagtaacaaacaacagacactccncgacccctgccgtcncacgcctcctcgtcggaccaagctcgcctagacncgtgtcgaggtncgcgagccgtagaggacggagcgtagtaagttacttacgtcgtccgtagccttattaagttcggttcgggggttcgggttccggttggggttcgggttcgggacggacgggtacaacggtcgtaccggtacccgtacgtcggaaccaccggaccgtaacggcccgtacccgtccccgttcggttcccttaccgttcccttccccggttaacccctacccgttacccgaccgtaaccgccgggtaacccgg

SEQ ID NO: 415581 - DNA, 736 bp, Homo sapiens
  misc_feature: GZ8MTXP01D6KCL.8.43.D10.1.454.CMB.2.raw
  modified_base (222)..(222): a, c, t, g, unknown or other
  modified_base (272)..(272): a, c, t, g, unknown or other
  modified_base (305)..(305): a, c, t, g, unknown or other
  modified_base (350)..(350): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggancagtcacctagttgttactactaccaaactcggttaccagcaagaaaccnggaacaacgcacccgaggaccactagtatttanaagtaaacaaacaacagaccactcctcggacccctgtcccgttcncgacggtcctcccgtccgttcggggaccaaagtctcgccctacgaacctcgtgtacgtaggtcgtacgcgaacggtccgtaggacggacggagggtcgtaggtagttaacgttacgtcgtccgtgtacttacgttagtttacggttcgggggttcgggttcggttttaggggttcggttcggggaccgggtaacgggaccgtaaacggtccgtacggtaacccggttacgtaaccgggtaaccgttaacccggcccggaaaccgggttccccgttaccccggtccccccggtttccgggttccccttacccgttaaccccgtttcccggttaaccccccttaccccgttaccccgcccggttaacccgttaacccggtaacccggg

SEQ ID NO: 415582 - DNA, 618 bp, Homo sapiens
  misc_feature: GZ8MTXP01D6RWJ.8.43.D10.1.454.CMB.2.raw
  modified_base (291)..(291): a, c, t, g, unknown or other
  modified_base (334)..(334): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcacagtgttactataccaaactggttccagcaagaaacctggacaagcaccaggccactgatttanagtaacaaacaacagacactcctacggacccctgcccggttcncacggcctccctcgttcggggacccaaagcctcgccctagactcgtgtcgaggtgtcgacagcctagacggacgaggctagagttattacgtcgtctagtctactattagtgggggttgggtccgtttggggtcggttcgggacggtacgggaccgtaaggcgtacggtacccgttcgtacgggtccacggacccgtaacggttcccgtaccgtcccccgttcggttccttacccgttccgttcccgttccccgtccccgtcttaccgaaccgccggtaaccgg

SEQ ID NO: 415583 - DNA, 530 bp, Homo sapiens
  misc_feature: GZ8MTXP01B4GTA.8.43.D10.1.454.CMB.2.raw
  modified_base (354)..(354): a, c, t, g, unknown or other
  modified_base (364)..(364): a, c, t, g, unknown or other
  modified_base (385)..(386): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactgagcagtcacagtggttactatccaaatggttccagcagaaacctggacaagcaccagcactgattatagtacaaacaacagacaactcctggacccctgcccgttctcagctcctcttcgggcaaagctgccctgacnctgtcaggtntggcagcctgaggagaagggnngtagtattactgtctcgtctactattagtggggtggtcgttgggtggtcggcggacggacgacgcgtcgtaccgtcgtcgtcgacgaccgacgcgtccgcccgttccgttcacgtctccgtccctccctccgttacgtcgcgcg

SEQ ID NO: 415584 - DNA, 619 bp, Homo sapiens
  misc_feature: GZ8MTXP01AR05U.8.43.D10.1.454.CMB.2.raw
  modified_base (222)..(222): a, c, t, g, unknown or other
  modified_base (257)..(257): a, c, t, g, unknown or other
  modified_base (272)..(272): a, c, t, g, unknown or other
  modified_base (279)..(279): a, c, t, g, unknown or other
  modified_base (320)..(320): a, c, t, g, unknown or other
  modified_base (356)..(356): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttcagcacgtggancagtcactagtgtactatacaatgtcagcagaacngacagcaccagcacngtattanagtaacaaacaacagacactcctcggacccctgcccgttcncacgcctccctcgtcggacaagctcgccctaagacncgtgtcgaggtgtcgcgacgcccgtggaacggacggaacggtcgtaggaacgttacgttacgtcgtccgtcgttactacgttagttaggttcggggggttcgggttacggtttcgggggttacggttcggggacgggtacggaccgtaacggtcgtacggtacccgtacgtacggtcaaccggccgtaacggttccgtcccgtccccgttcgttccttaccgttctacccggtcccctaccgtccgttaccgcgaacgtccgg

SEQ ID NO: 415585 - DNA, 691 bp, Homo sapiens
  misc_feature: GZ8MTXP01BU4OK.8.43.D10.1.454.CMB.2.raw
  modified_base (163)..(163): a, c, t, g, unknown or other
  modified_base (220)..(220): a, c, t, g, unknown or other
  modified_base (278)..(278): a, c, t, g, unknown or other
  modified_base (283)..(283): a, c, t, g, unknown or other
  modified_base (288)..(288): a, c, t, g, unknown or other
  modified_base (294)..(294): a, c, t, g, unknown or other
  modified_base (303)..(303): a, c, t, g, unknown or other
  modified_base (319)..(319): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtcgtcccaggagggacagtcactctcacctgtgcttccagcacgtggancagtcaccgagtgttaactataccaaatggtacagcagaacctgacagcaccagcatnattanataanaaacanagacactcncgaccctgcccggtcncgacgtcctcccgtcgtcggacctaagctcgcccgtagactcgtgtaccgagggtcgtacgcgacgtcccgtagggacgggtaccggagtaccgttaggtaaacgttaacgtttaccgcgttaccccgtggttacctttacttaaggttttcgggtcgggggttcggggttccgggttttgggggtccgttaccgggggacgggtaaccggtaccgtaaacgggtccgttacggtaccccggttaccgtaacgggtaacgaccggttacccgggtaacggttccccgtcccggtcccccgttcgggttaaccttcccggttccttacccgttccccccgaacgttccgacccggtaaccgaacccgggtcgg

SEQ ID NO: 415586 - DNA, 642 bp, Homo sapiens
  misc_feature: GZ8MTXP01AOZV1.8.43.D10.1.454.CMB.2.raw
  modified_base (222)..(222): a, c, t, g, unknown or other
  modified_base (288)..(288): a, c, t, g, unknown or other
  modified_base (331)..(331): a, c, t, g, unknown or other
  modified_base (610)..(610): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccagcactggancagtcacagtgttactataccaaactgtccagcaagaacctggacagcaccagccactgtaattanaagtaacaaacaacagacactcctcgacccctcgcccggttcncgacggcctccgtcgtccggggaccaaagctacgccctaagacctgtcgtacgtagggtcgtacgcgacgaccgtagacggacggaggtctagtacgttacttacgtcgtcccgtgtacttacttagtttaggtcgggggttcgggtcggtttggggtcgggttacgggcgggaacgggtaccaggtccgtcggtacccgttacgtcgggtaaccacggaccccgaacggttcccgtcccggtccccgttacggttccttccgtccctcccggttcccnccccgtccgttaccgaacccgttaacggccgg

SEQ ID NO: 415587 - DNA, 761 bp, Homo sapiens
  misc_feature: GZ8MTXP01EK99Z.8.43.D10.1.454.CMB.2.raw
  modified_base (291)..(291): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccgaggaggacagtcactctcacctgtgcttccagcactggagcagtcacctagtgttactactacaactcggtacagcaacgaactggacagcaccgagcactgactttanagtaacaaacacaacgacctactccgtacgtacccctcgtcccggttcacgtaccggtcctccccgtccgtacgggacctaaacgctaccgcccgtaagaaccgtccgtgtaccgtagggttcgtaccggaccgacggtcccgtagggaacgggtaaccggagggtccgttaaggttaacggtttaaacctttccggtaccgtacccggtttacgttaccgtttaaggtttaacggtttaccggggtcgggggggggttttacggggttccggggttttacgggggttccgggttacccggggaacggggtaaccggtaaccgtaacgggtccggttaccggtaacccggttacggtacggtaacccgaaccggttaccgtaacggttcccgtccccgggtaccccttcggttacccttccgttaacccctacccgttccccgtacccgtccgttaccgtaaccgcggcg

SEQ ID NO: 415588 - DNA, 515 bp, Homo sapiens
  misc_feature: GZ8MTXP01B5VG4.8.43.D10.1.454.CMB.2.raw
  modified_base (444)..(444): a, c, t, g, unknown or other
  modified_base (463)..(463): a, c, t, g, unknown or other
  modified_base (467)..(467): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacagcacccaggccactgatttatagtacaaacaacagacactcctggacccctgcccggttctcaggctccctccttcggggccaaagctgccctgacaactgtccagggtgtgcagccctgaggacgaggctgagtattactgcctgctctattgtggggtggtcttgggtgttcggnggtaggacagctgcgtccngtcncgcctagctcgccccttcggcactctcgtcccacctcttcgcaacgcg

SEQ ID NO: 415589 - DNA, 698 bp, Homo sapiens
  misc_feature: GZ8MTXP01ES8KN.8.43.D10.1.454.CMB.2.raw
  modified_base (366)..(366): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccgaggagggacagtcactctcacctgtgcttccagcacgtgagcagtcaccgtgtgttactactaccaaactggttaccagacaacgaaacctggaacaacgccaacccgaggcctaatagtatttaactaagtaaaccaaaacaacacgtaaccacctaccgtaccggacccctcggtcccgtttcnccgacggtccctcccgtccgttaccggggacctaaaggtcctcgaccccgtaacgacctcgttacggtacgtaggggttacgtcgacgtacggacctaggggaacgggaacggtacgggtacgtagtaacggtttaactaccgtcggtcctgtcttacgttagtttacggttgggggtcggttcggttggggttcggttacgggacgggacggacgaacggtccgtacggtacccgtcgtacggtcaccgccgtaacggttcctcccggtccccttcggttccttaccgtcgttccctccccgtaccgtccgacgtaacccgcggtaaccgg

SEQ ID NO: 415590 - DNA, 583 bp, Homo sapiens
  misc_feature: GZ8MTXP01AXYEU.8.43.D10.1.454.CMB.2.raw
  modified_base (280)..(280): a, c, t, g, unknown or other
  modified_base (318)..(318): a, c, t, g, unknown or other
  modified_base (556)..(556): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgttgcccagggtccaattctcagactgtggtgactcaggagccctcactgactgtcgtccccaggagggacagtcactctcacctgtgcttccagcactggagcagtcaccagtgttactataccaatggtcagcagaactgacagcaccagccatgattanagacaaacacagacactccgacgacccctgcccgttcncgacgtcctcctcgtcgggacccaaacgctcgccctgaaccactcgtacgagggtgtcgacgacggtcgtagggacggacgaggcgtggtacgtattacgtgaccgtgtccttatacgttagtcgggtcggggtcggttggggtggttcgggacggacggacaggctcggtacgtccgtagtcaaccggccgacgggccttccgccccgtcgttccgttccttccgtcccgttccccncccgttccgacgaccgaacgcgaacgg

SEQ ID NO: 415591 - DNA, 576 bp, Homo sapiens
  misc_feature: GZ8MTXP01A8YKA.8.43.D10.1.454.CMB.2.raw
  modified_base (164)..(164): a, c, t, g, unknown or other
  modified_base (291)..(291): a, c, t, g, unknown or other
  modified_base (376)..(376): a, c, t, g, unknown or other
  modified_base (425)..(425): a, c, t, g, unknown or other
  modified_base (434)..(434): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggagcagtcaccagtggttactatccaaactggttccagcagaaacctggacaagcacccaggccactgatttanagtacaaacaacagacactcctcggacccctgcccggttactcacggctcccgtccgttcggggaccaaagctcgccctagaccnctgtcagggtctgcagcctgaggacgaggctgagtatacgtgcctgctntagttacgnggggtcgggtcgttgggtcgttcgggcggaggaccgaagctcgaccgtcgtaggtcacggccgaaacggccgtaccgtcccccgttcgggttccaccgttcctccggttccccaccctcccgttaccgaaccgccgaaccgg

SEQ ID NO: 415592 - DNA, 739 bp, Homo sapiens
  misc_feature: GZ8MTXP01CSNM6.8.43.D10.1.454.CMB.2.raw
  modified_base (220)..(220): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccaggaggacagtcactctcactgtgcttccagcactggancagtcaccgtagtacgttactactaccaaacgtcggttaccagcaacgaaaccgtggaacaacgcaacccgaggacccaactagtaactttaataacgtaaaccaaaacaacaacgaccacctacccgtcggacccccttcggtccccgttacgtccgacggtcccttccccgtccggttaccggggacccaaacgccgtaccgaccctacgacctcgtagtcgtacgggtgtcgacgacgcgtaggaggacggtaggctagtaagttacttacgtcgtcctaggtccttacttaagttcgggtcggggggttcgggtttcccggggtttggggtacgggtttaccggggaccgggtaacgggtaccgtaaacgggtccgttaaccgggtacccggttaccgtacgggtaaccgaaccggacccggtacggttcccgtaccccggtccccgttcggttcccttacccgttcccgtacccgttcccctacccgtccgttaccgaaccgttccggaaccgg

SEQ ID NO: 415593 - DNA, 688 bp, Homo sapiens
  misc_feature: GZ8MTXP01A4DYQ.8.43.D10.1.454.CMB.2.raw
  modified_base (164)..(164): a, c, t, g, unknown or other
  modified_base (290)..(290): a, c, t, g, unknown or other
  modified_base (314)..(314): a, c, t, g, unknown or other
  modified_base (335)..(335): a, c, t, g, unknown or other
  modified_base (394)..(394): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtcgtccccaggagggacagtcactctcacctgtgcttccagcacgtggagcagtcaccagtcggttactataccaaactggttccagtcagaactgacagcaccaggcactgatttanagtaacaaacaacacgacactccncggacccctcggtcccggttncgacggcctcctcggttccgggaccaaagctcgccctagactaacgtcgtcgagggttntgccgagcccgtaggaggtacggaggctaggtagttacttacgtcgtccgtcgtacttacgttagttaggttcggggggttcggggttccgggtttagggggttccggggtttacggggaccggggtaacggggtaacccgtaacggtcccgttaccggggtaccccgttaaccggttcgggtaaccgacggttaccccgaaccggttcgtacccggtcccccgttacgggttacccttccgttaaccggtaccccgtcccctttacccgacgaacccgccggttcgtaaccgg

SEQ ID NO: 415594 - DNA, 645 bp, Homo sapiens
  misc_feature: GZ8MTXP01D630W.8.43.D10.1.454.CMB.2.raw
  modified_base (221)..(221): a, c, t, g, unknown or other
  modified_base (287)..(287): a, c, t, g, unknown or other
  modified_base (289)..(289): a, c, t, g, unknown or other
  modified_base (325)..(325): a, c, t, g, unknown or other
tcagctcgcgtgtccacgaccggtgctcgatttagactagcagtaagggggcaccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccagcactggancagtcacgagtgttactataccaaagtgtaccagcaagaacctgacaagcaccagccatgtattananaaacaaacacagacactctcggaccctcgccgttcncacgtcctcccgtcgtcgggaccaagtcctcgcccagactcgtgtacgagggtgtcacgagacccgtaggacgggacgaacggtgtaggttaaagttacgttacgtcggtacccttggtaccttaacgttaggtttacgtcggggggttacgggtttccgggtttggggttcgggttcgggacgggtacgggtacctaacggtccgtacggtacccgtccgtaggtaacccgacgacccgtaacggttcctacccggtccccgttcgttcttacccgttcgtcccgttcccccgcccgtccgacctaaccgaacgccggg

SEQ ID NO: 415595 - DNA, 678 bp, Homo sapiens
  misc_feature: GZ8MTXP01AYEXZ.8.43.D10.1.454.CMB.2.raw
  modified_base (260)..(260): a, c, t, g, unknown or other
  modified_base (270)..(270): a, c, t, g, unknown or other
  modified_base (281)..(281): a, c, t, g, unknown or other
  modified_base (319)..(319): a, c, t, g, unknown or other
  modified_base (357)..(357): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtgttactataccaactgtccagcagaacngacagcaccngcatgtattanagtaacaaacacagacactccgcgaccctgcccgttcncacgcctccctcgtcgggaccaagctacgcccaagacncgtcgtcgagggtgtcgcacgtccgtaggacggacgaggtacgtaggtagttaacttacgttcgaccgttcgtaccgttacttagtttaggttcggggggttacggggttccccggtttgggggttcgggtttaccggggtacgggggaaccgggtaccgtaaacgggtcccgttacggtaaccccggttcccgttaacgggccgttaacggaccccgtaaacgggttcccgtcccggtcccccgttaccggttccgttacccgttccgttcccggttcccccgaccccgttccgttacccgaaccgttaacccggtccgg

SEQ ID NO: 415596 - DNA, 693 bp, Homo sapiens
  misc_feature: GZ8MTXP01ADU81.8.43.D10.1.454.CMB.2.raw
  modified_base (219)..(219): a, c, t, g, unknown or other
  modified_base (293)..(293): a, c, t, g, unknown or other
  modified_base (339)..(339): a, c, t, g, unknown or other
  modified_base (399)..(399): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggaggacagtcactctcacctgtgcttcagcactggacncagtcaacctagtggttactactccaaactggttaccagcaagaactggacaagcacccaggccactgatttanagtacaaacacagaccacgtccgtaggacccctggtaccccggttnaccgacggtcctacccgtcgttacggggaccaaggtcctcgccctggaacctgtcgtacncgggtagtcgacgacgtaccgtaggaacggacggtacggtaccgttaggtaacgttaacgttaaccgtcggttaacccgttcggttacccgtttacgttaaacgttttacggtacgggggggttccggggtttccggttttggggggttaccggtttaccggggaccgggtaacgggtaccgtaacggtccggttaccggtacccggtccgtacggtaacgacgttcccgaagttcccgtcgtaccccttggttccaccgtcgtcgtcccgccttccgacgcgttaaccggccg

SEQ ID NO: 415597 - DNA, 617 bp, Homo sapiens
  misc_feature: GZ8MTXP01AMAIX.8.43.D10.1.454.CMB.2.raw
  modified_base (285)..(285): a, c, t, g, unknown or other
  modified_base (370)..(370): a, c, t, g, unknown or other
  modified_base (563)..(563): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggtccagcagaaacctggacaagcacccaggcatgatttanagtaataaacaacagacactcctcggacccctgcccggttctcacggcctccctccgttcggggaccaaagcctcgccctgaccncgtgtcaggtgtgcagcctgaggacgaggcgtggagtagtactcgcctgtctctatttacgtggggggttcgggtccggtttggggtcggtttcgggcgggtacgggggaccgaacggtccgtcggtacccggtaccgttacggtccgacggcccgtaaacggttccgtccggtcccccgttccggttacccnccgttcctcccggtttccccacccctcccgttaccgtaaccgaacccggtccgg

SEQ ID NO: 415598 - DNA, 889 bp, Homo sapiens
  misc_feature: GZ8MTXP01BBDGB.8.43.D10.1.454.CMB.2.raw
  modified_base (221)..(221): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtcccgaggaggacagtcactctcacctgtgccttcagcactggancagtccacgtagtcgttaactactacctaacgtcggttaccagtacaagtaaaccgtggaacaacgccaacccgacgcctacgtagtaatttaacgtaagtaaaccaaaacaaacgtaacgaaccctaacccgtaccccgtacccgggacccccttaccgggtcccccggtttctaccgtacggtccccttcccccgttcccggtttacccgggggacccctaaaacgggtccctaccggtacccccttaacgggaacccttccggttaggttcccggtaaggggttccgttcggaccgtacgggtacccggtacggaacggggacggacgggtaccgtagggtaacgtttacgttaaccgtcgtccgttcggtacctttaccgttagtttagggtcggggggtttacggggttcccgggtttacggggttcggggtttccggggtaaccgggggtaacccgggtaaccggtaacgggtcccgttacccgggtaccccggttacccggttacgggtaaccccgtaaccggaccccgggtaaacgggttccccgttaaccccggtccccccgggttccgggtttcccgttacccccgtttcccggttccccgtttccccccggtccccgttaccccgttaccccggaacccgttaacccgggtcccggg

SEQ ID NO: 415599 - DNA, 709 bp, Homo sapiens
  misc_feature: GZ8MTXP01EZWUP.8.43.D10.1.454.CMB.2.raw
  modified_base (224)..(224): a, c, t, g, unknown or other
  modified_base (681)..(681): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtcccgaggagggacagtcactctcacctgtcgcttccagcacgtggancacgtcactagtgttactactaccaacgtcgtacagacaacgaaacctaggaacaacgccaaccgacgacctacgtataatttaacaagtaaacaaaacaacaagacctaccgtccgtaccggacccctcggcccggtttcacacggtcctcccgtcggtaccggaccaaacgctcgccctaagactcgtggtcgtagggtgtcgacgacggtccgaggacgggacggtaggacgttagtaacgtttaacttcgtcgtccgttagtcctttacttaaggtttcgggttcgggggggttcggggtttaccggggtttggggttacgggtccggggtacgggaacgggacgtaacggccgtacggtacccgtcgtaacggtcggaaccgttacggaccggttcccggccgttccccgttcccggttccgttaccctcccgttccgttccccgttacccnccccgttacgcccgttaaccgaaccggg

SEQ ID NO: 415600 - DNA, 691 bp, Homo sapiens
  misc_feature: GZ8MTXP01B2KHQ.8.43.D10.1.454.CMB.2.raw
  modified_base (221)..(221): a, c, t, g, unknown or other
  modified_base (298)..(298): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcacctagtggttactataccaaactggttaccagcaagaaacctggaacaagcacccaggccactgtattaanagtaacaaacaacagacactccgtcgacccctgcccggttctcgacggcctacccgtccgtacggggaccaaagctcgccctagacctcgtgtacgagggtcgtgcagcccgtaggaggaccggaggctagtaagtacgtttactcggtaccttgaccttattaaagtttcgggtcggggggtttcggggtacccggtttgggggtcgggttacggggcgggtaacgggacccgtaaaggtccgttacggacccgttaccggtaagggtccgaaccggcccgaaacgggttcccttacccgggtcccccgttacgggttcccttaaccgttcccggttccccgttcccccggcccctttcccgttacccggtaaccccgaaccgggtcccggg

SEQ ID NO: 415601 - DNA, 763 bp, Homo sapiens
  misc_feature: GZ8MTXP01EMNSW.8.43.D10.1.454.CMB.2.raw
  modified_base (218)..(218): a, c, t, g, unknown or other
  modified_base (283)..(283): a, c, t, g, unknown or other
  modified_base (296)..(296): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactgancagtcacagttggttactactaccaaactggttaccagtcaagaaacctggaacacgacacccgngccatgtatttanagtaaacaaacaacacgactactccgtacgacccctcggtacccgttctacgtacggtcctcccgtaccggttcggggacccaaagtcccgtcgaccccttagacccgtaacgtcgtacgtagggtcgttacgacgagggtcccgtagggaacggtacggaacggtcgtacggtaagttaaccttacgtcggtcctcggtaccttaccgtttaagttacgggttcggggggtttcggggtttccgggtttacggggttcgggggtttaccgggaccgggggtaacggaaccggtaccgggttacgtacccggtacccggttaccgtacgggttaaccaccggttacccggtaaacggttcccggttcccggtcccccgttaccggttcccgttacccgtttccccggttaccccggtttaaccccaaccccgttccccgttaccgtaacccggttcccggtccgggg

SEQ ID NO: 415602 - DNA, 720 bp, Homo sapiens
  misc_feature: GZ8MTXP01AKLT2.8.43.D10.1.454.CMB.2.raw
  modified_base (309)..(309): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccagcacgtggagcagtcacctagtgttactactaccaaactcggtccagccaaagaacctaggaacaacgccacccacggaccacgtagtaatttaanaacgtaaaccaaacaaacagaacctactccgtccggtacccctcgtccccgttcgtccgaccggtccttccccgtccggttaccggggaccaaacgtcgtaccgcccgtaacgacctaacgtcggtaccgtaggggttcgtacgggccgacggtccgtacgggaacgggaccgggacgggtacgtaggtaagttaccgtttacgtccggtcctgttcttacgttagtttaggtggggggttcggggtttcggttcgggggttacgggttacgggggaccgggtaccgggtaaccgtacggtccgtaccggtacccgtcggacggtaaccgaccgacccgacggttcccgtcccgtccccgttcggttccacccttcgtcccgtcccctcccttcccgcgtaaccgcggccg

SEQ ID NO: 415603 - DNA, 666 bp, Homo sapiens
  misc_feature: GZ8MTXP01D3LZD.8.43.D10.1.454.CMB.2.raw
  modified_base (293)..(293): a, c, t, g, unknown or other
tcagctcgcgtgtccacgaccggtgctcgatttagactagcagtaaggggggcgccaggggtccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacctagttcggttaactactaccaaactcggttaccagcaagaacctgacaagcaccagccatgattanagtaaacaaacaacagacactcgtcgacccctcgtcccgtctcgagcctcctccgttcgggaccaaagctcgccctaagactaacgtcgtacgaggtcgtcgcgacgcccgtaggacgggtacggagggtcgtaggtaacgtttaacgttacgtcgtacccgtcgtacgttacgtttaagtttacggttcggggggttacggggttcccggtttgggggtcgggtttaccggggacgggtacgggacgtaaacggtcgtacggtacccgttcgtacggtctaccggccgtaacggttcgtacccggtccccttacggttccaccgttccgtccgttccccgcccgttccgttacccgtaacgccggtaaccgg

SEQ ID NO: 415604 - DNA, 735 bp, Homo sapiens
  misc_feature: GZ8MTXP01EWONL.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccaggaggacagtcactctcactgtgcttccagcacgtggagcagtccaccgtagttgttaactactaccaaacgtcgtaccagacaacgaaacctggaacaacgccaccgaggccaactgtaattaataacgtaaacaaaacaacaacgacctacctcccgtaccggtaacccccgtccggtaccccggtttctaccggacggtcccttacccccgtccggttacccgggggacctaaacgccgtccgtaccccgtagaaccgtaaccgttgtaccgagggttcgtacgaccgacgtccgtaggacggagtacggtcacgttaagttactacgtcgccgttatccgttattaacgtttgggttcgggggttccgggtttccggggtttaggggttacggttacccggggaacgggtacggtaaccgtaagtccgtacggtacccgtttaccgaggaaccgaacgacccgggtaacgttcccgtacccggtccccgttacggttccttaccgtttccgtccgtttaaccccgccccgttcgccgaacgttaacgccgg

SEQ ID NO: 415605 - DNA, 459 bp, Homo sapiens
  misc_feature: GZ8MTXP01AC91I.8.43.D10.1.454.CMB.2.raw
  modified_base (164)..(164): a, c, t, g, unknown or other
  modified_base (215)..(215): a, c, t, g, unknown or other
  modified_base (230)..(230): a, c, t, g, unknown or other
  modified_base (249)..(249): a, c, t, g, unknown or other
  modified_base (265)..(265): a, c, t, g, unknown or other
  modified_base (270)..(270): a, c, t, g, unknown or other
  modified_base (279)..(279): a, c, t, g, unknown or other
  modified_base (337)..(337): a, c, t, g, unknown or other
  modified_base (340)..(340): a, c, t, g, unknown or other
  modified_base (351)..(351): a, c, t, g, unknown or other
  modified_base (375)..(376): a, c, t, g, unknown or other
  modified_base (378)..(379): a, c, t, g, unknown or other
  modified_base (381)..(381): a, c, t, g, unknown or other
  modified_base (385)..(385): a, c, t, g, unknown or other
  modified_base (391)..(391): a, c, t, g, unknown or other
  modified_base (400)..(400): a, c, t, g, unknown or other
  modified_base (402)..(402): a, c, t, g, unknown or other
  modified_base (408)..(408): a, c, t, g, unknown or other
  modified_base (410)..(410): a, c, t, g, unknown or other
  modified_base (414)..(414): a, c, t, g, unknown or other
  modified_base (417)..(417): a, c, t, g, unknown or other
  modified_base (436)..(436): a, c, t, g, unknown or other
  modified_base (451)..(451): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtgtcccaggaggacagtcactctcactgtgcttcagcactgancagtcacagtgtacntcaaactgtcagcagaacngacagcaccagcactnattanagtacaaanacagacactctggaccctgcccgttctcagctcctcgtcgggacaaagctagccgtanacnctgtcaggttngcagctgagacgagctgatatacnncnntntatntggtgngtgtgtcgngngacgantncgcngcncgcgacgcgcgccttcgcnctctcgtccgcctcncgcgcgcg

SEQ ID NO: 415606 - DNA, 585 bp, Homo sapiens
  misc_feature: GZ8MTXP01AQN8M.8.43.D10.1.454.CMB.2.raw
  modified_base (291)..(291): a, c, t, g, unknown or other
  modified_base (543)..(543): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcagaaacctggacaagcacccaggccactgatttanagtacaaacaacagacactcctcggacccctgccccggttctccaggcctccctccgttcggggaccaaagctcgcccctagaccaactgtccgagggtcgtgcacgcctgaggacgaggctgagtattactgcctgctctaagtttcgtgggggtcgggtccgttggggtcggttcgggcgggacgggaccgaaggctcggaccgtccgtggtccacgcccgtaacggccgtcgcccccgttcggttaccnccgttcctcgttccccaccctccgttccgtaaccgaacgccg

SEQ ID NO: 415607 - DNA, 714 bp, Homo sapiens
  misc_feature: GZ8MTXP01A2Q3L.8.43.D10.1.454.CMB.2.raw
  modified_base (297)..(297): a, c, t, g, unknown or other
  modified_base (339)..(339): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccgtagtggttaactatacctaaactcggttcagctaagaaacctggacaagcaccgaggccatgtattanagtaacaaacaacagacactccgtcgacccctgcccggttcnccgacggtcctccctcgttccggggaccaaacgctcgccctacgactcgtagtcagggtcgtcgctacggccgtaggacggtggaacggtctacggtagttaacttacgtacgccgtacgtcttacgttatttacgggttcgggggttcggggtccggtttaggggtcgggttaccggggacggggacggggtaaacctaacgggcgttaacccgggtccgtaaccggttacggggtaacccaaccggttaccccggtaacggccccgttaaccggcccccccggtttaccgggttcccttaacccggttcccgttaccccgttaacccccgaacccccgttcccgttaccggtaacccgaacccggtaaccggg

SEQ ID NO: 415608 - DNA, 700 bp, Homo sapiens
  misc_feature: GZ8MTXP01CVU1A.8.43.D10.1.454.CMB.2.raw
  modified_base (165)..(165): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctnactgactgtgtccccaggagggacagtcactctcacctgtgccttccagccacgtggagcctagtccaaccgtaggtcggttaactaactacccaaaacgttggttacccagcaacgaaacctggaacaagcacccgagccactgattataacgtaacaaacaacagaccaacctccgcggacccctcggtccccggtctcacggcctcccgtccggttccgggaccaaacgctccgccctagacctcgtgtacgaggtggtcgacgtacggcccgttagacgggtacgaacgggtctacggtaaggttaacttacgtcgtccgtcggttctacgttagttagttcgggggttggggttcccggtttagggggttcggttcggggacgggtacggaccgtaacggccgttcgggtaccgtccgtaggtcccgacggccccgtaacggccgttcccggcccccgtttcggacccttcccgttcccttacccgttcccctaccccgtccccgttaccgtaaccgttccggtaaccgg

SEQ ID NO: 415609 - DNA, 756 bp, Homo sapiens
  misc_feature: GZ8MTXP01C19EQ.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcggactgtggtgactcaggacgccctcactgactgtcgtccccgaggagggacagtcactctcacctgtcgcttccagcacgtggagcagtccaaccgtaggttacgttactactaccgaaacttcggttaccagacaacgaaaccgtggaacaacgccaacccgacggacctaagttagtaatttaacgtaacgtaaaaccaaaacaaacgtaacgaaacctaccccgttaccccgtaccggtacccccgttcggtacccccggttttacgaccgtacggtccccttcccccgtttacggttaccggggaaccccctaaacggtccgtaccgtcccctacggaaacctacgttcggtaccgtaggggttcgtacgccgacggcccgtagggacggacggtacggtacgtagggtacttacgttacgtccgtcgttcgtcttacgttaggttaggtcggggtttcggggttcggttggggtcggtacgggacgggtacggaacgtggtccgtacgtccgtacgcggtcgaacgccgttacggtcccgttccgtaccccgtcggttaccttccgttccttccccgtccctccccgtcgaccgacgtccgttcggtaacg

SEQ ID NO: 415610 - DNA, 815 bp, Homo sapiens
  misc_feature: GZ8MTXP01CGKEP.8.43.D10.1.454.CMB.2.raw
  modified_base (214)..(214): a, c, t, g, unknown or other
  modified_base (223)..(223): a, c, t, g, unknown or other
  modified_base (773)..(773): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccgaggaggacagtcactctcacctgtcgcttcancacgtggancagtccacctagtcggttaactactacctaaacgtcggttacagacaacgaaaccgtgaacaacgccaacccgaggccagtagtatttaatagtaaacaaaacaacgaacgacctaccgtccgtacggtaccccctcggttccccggtctaccgacggtcccttccccgttccggttacccggggaacccaaacgtccgtccgacccgtaagacctcgtcgtcgtagggtgtacgccgtacgacccgtaggacgggacggacgggtacgtacggttaacgttacgtttaaccgcgtccgtttaacgtccgttaccgttaaagtttcgggttcggggggggtttcggggtttaccgggtttcgggggttcgggttacccggggaaccgggaagggtaaaccccgtaacggtcccggttaccggtaccccggtttaccgtaacgggttaaccggaaccggttaccccggtaaacggttcccggttacccccgggtaacccccgttcccgggttacccttaccccggtttccctttccccgggttaacccccnccccgtttacccggacccgtaaccgttcccggggtaacccgg

SEQ ID NO: 415611 - DNA, 815 bp, Homo sapiens
  misc_feature: GZ8MTXP01BIX4S.8.43.D10.1.454.CMB.2.raw
  modified_base (220)..(220): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacctagtgttactactcaactcggttaccagtcagaaacctggacaacgcacccaggccacgtgtattagacgtaacaaacaacagacacctcctacggacccctcggtccccggttctacgacggccctccccgtccgttccggggacctaaagggcctcgacccctagggaacctcgtacggtacccgtaaggggttcgtcggacctaacgggtcccgttacgggtaacggggacgggaacgggacctttacggggtaagtttaacgtttaaccgttacgtaccccgttcgggttacctttaaccggttaaacgtttagggtttcggggggttcccgggggttttaccgggtttccgggggtttcgggtttaccggggaccgggggttaaccgggacccggttaaacgggtcgttacccgggtaacccgttaccgggtaaccgggttccaacggttacccggtaaacgggttcccgttaacccgtcccccccggtttaacgggttccccttaacccggttcctttcccgggttaacccccctaaccccgttcccggttacccggtaacccgttaacccgggtcccggg

SEQ ID NO: 415612 - DNA, 775 bp, Homo sapiens
  misc_feature: GZ8MTXP01C812S.8.43.D10.1.454.CMB.2.raw
  modified_base (221)..(221): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttcagcacgtggancagtcaaccgtagttcggttaactactaccaaacgttcggttaccagactaacgaaaccgtggaaacaacgccaacccgacggaccacttagtaactttaataacgtaaacaaaacaacacgaaccacctaccgtaccggacccctcggtaccccggttctaccgacggtcccttccccgttccggtttaccgggggaaccctaaaggtccgtaccgccccgttaacgaacctcgttcggtacgtacgggtcgtcgacgtacgtacccgaggacggacggacggtctaggtaacgttacgttacgtcgtccgtagtaccttagttaagtttacgggttcggggggttcggggttcccgggtttgggggtacgggttcgggaaccggggtaacgggtaaccgaaacgggtccgttaccggtacccggttccgtaacgggtccaaccggacccggtaacggttccgttaccccgtcccccggttccggttccttaccccggtttcgttccccggttccccgccccgttaccgttacccgtaaccgcggtaacccgg

SEQ ID NO: 415613 - DNA, 673 bp, Homo sapiens
  misc_feature: GZ8MTXP01DS5CR.8.43.D10.1.454.CMB.2.raw
  modified_base (222)..(222): a, c, t, g, unknown or other
  modified_base (361)..(361): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccagcactggancagtcacctagttgtactatacctaaacgtcgtacagacaagaaacctggaacaacgcacccgaggacccatagtaatttaataacgtaaacaaaacaacagaacctacctaccgtaccgaccccttcggccccgttcnccgacggtccttcccgtccgtccgggaccaaacgccgtcgaccctagacctccgtgtacgacgggtgtcgactacgccgtaggacggacggacggtactacggtagttacgtacgtcgtaccgtgtccttacttagtttacgtggggggtcgggttacgggttgggttcggttcggggacggtacgggacaacggtcgtccggtaccggtcgcggtaaccgaccggcccgaacggccgtcccggtaccccttccgggttccttacccttccggtccctcccctcccgcccgttacgaaccgttcggtaaccg

SEQ ID NO: 415614 - DNA, 621 bp, Homo sapiens
  misc_feature: GZ8MTXP01AJSSH.8.43.D10.1.454.CMB.2.raw
  modified_base (222)..(222): a, c, t, g, unknown or other
  modified_base (276)..(276): a, c, t, g, unknown or other
  modified_base (288)..(288): a, c, t, g, unknown or other
  modified_base (300)..(300): a, c, t, g, unknown or other
  modified_base (379)..(379): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggancagtcacctagtggttactataccaaatcgttacagcaagaactgacagcaccnggcactgattanagtacaaacaanagacactcctacggacccctagccccgttctcgacggtcctcccgtccgttacggggcccaaagctcgcccgtagaccncgtgcctagggttcgagtcaggcgtagacggtacggacgtgtagacgttatacgtcgtcctgtctacttagttacgtggggggtggttccggttggggttacggttcgggacgggtacgggacctaaaggtccgtacgtacccgttacgtcggtcgacgaccgaacggttcgtcccgtaccccgttcgccgttccctcgttcccgtccccgtcccgtaccgttcctaacgttccgtaaccgg

SEQ ID NO: 415615 - DNA, 658 bp, Homo sapiens
  misc_feature: GZ8MTXP01BZSGM.8.43.D10.1.454.CMB.2.raw
  modified_base (222)..(222): a, c, t, g, unknown or other
  modified_base (264)..(264): a, c, t, g, unknown or other
  modified_base (282)..(282): a, c, t, g, unknown or other
  modified_base (287)..(287): a, c, t, g, unknown or other
  modified_base (365)..(365): a, c, t, g, unknown or other
  modified_base (375)..(375): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggancagtcaccagtggttactatcaaactggtcagcagaactganaagcaccagcatgattanagtanaaacaacagacacctctcggacccctgtcccgttctcaggcctcccgtcgtcggggaccaagtctcgcctaagactcngtccagggtntcgcacgccctaggacggacggaggctaggacgttaattacgtcgtacctgtaccttcgttaagtttacggttggggggttcgggttcgggtttcggggtcgggtttacggggcggggtaacgggaccgaaacggtcgtaccgggtacccgttacgtacgggtaacctacggccccggaacggttcccgtccccgtcccccggttcgggttcccttacccgttccctttacccggttccccctaaccccgtttcccgacccggtaacccgaacccgggtcccg

SEQ ID NO: 415616 - DNA, 586 bp, Homo sapiens
  misc_feature: GZ8MTXP01EHRVP.8.43.D10.1.454.CMB.2.raw
  modified_base (164)..(164): a, c, t, g, unknown or other
  modified_base (207)..(207): a, c, t, g, unknown or other
  modified_base (221)..(221): a, c, t, g, unknown or other
  modified_base (256)..(256): a, c, t, g, unknown or other
  modified_base (276)..(276): a, c, t, g, unknown or other
  modified_base (281)..(281): a, c, t, g, unknown or other
  modified_base (303)..(303): a, c, t, g, unknown or other
  modified_base (318)..(318): a, c, t, g, unknown or other
  modified_base (368)..(368): a, c, t, g, unknown or other
  modified_base (406)..(406): a, c, t, g, unknown or other
  modified_base (410)..(410): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtcgtccccagggagggacagtcactctcacctgtncttccagcatggancagtccacagtgttactataccaaatgtcagcaanaactgacagcaccagcactnattanagtaacaaacacagacactccnggacccctgcccgtncgagcctacctcgtacggccaaagctcgcctagactcgtgtcgaggtcgncgacgccgtgaggacgaggtctagagttacttacgtcncgtncttacgtattacggtgggggttcgggtcggtttggggttcggttcgggcgggacggaccgagtcgtcgtaccgtcgtcggtaacgacgccggtaacgcgtcccggacccgttccggttccttaccgttccgttccgtccccttcccgtccgttaccggtaaccgttcggtaaccgg

SEQ ID NO: 415617 - DNA, 628 bp, Homo sapiens
  misc_feature: GZ8MTXP01AU22Z.8.43.D10.1.454.CMB.2.raw
  modified_base (220)..(220): a, c, t, g, unknown or other
  modified_base (339)..(339): a, c, t, g, unknown or other
  modified_base (599)..(599): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttcagcactggancagtcaccgagtgttactataccaaacgttcgtccagcaagaaaccgtgaacaacgcaccagcctactgtattagtaagtaacaaaacacagacactcccgtcgacccctgcccgttcnctacggccttccctacgtccgggaccaaagtctaccgctacgactcgtgtcgtaggttgcgtcgactcccggtagacggacgaaggtccgtagaagttactactcgtccgtagccttacgtagttaggtcgggggtggtccggtttggggtcgttcgggacgggtacggaccgtacgccgttcgaccgtccgaggtccaaccggttaccgaacgttccgtcccgtaccccgttcggccttactcccgtccgtaacccccncccttaccggccgtaaccgaaccggtccg

SEQ ID NO: 415618 - DNA, 731 bp, Homo sapiens
  misc_feature: GZ8MTXP01BP4X1.8.43.D10.1.454.CMB.2.raw
  modified_base (716)..(716): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtcccgaggagggacagtcactctcacctgtcgccttcagccacgtggagcagtccaccgtagttggttaactactaccaaacgttcggtaccagacaacgaaccgtggacaacgccaccccgaggaccctaactagtaatttaacgtaagtaaaccaaaacgaaactaacgacctacccgtccgtacccggacccccttccgggtaccccggtttctaccgaccgggttcccctcccggttacccggttccggggaaccctaaacggccctccgcccgtaaagacctcgttgcgtagggtcgtgccgtagccgtaggaccggaggacgtcgtaggtatttacgttacgtctccgttcggtacttacgtttaagtttcgggttcggggggtttacggggttccgggtttggggtaccggggtttacggggacgtacgggaacccgtaggtccgtcgtacccggtcgtggaaccgtcgaccggtacgcccgtcccgtaccccggttcgttcccgttcttccgtcccgtccctacccgtcccncggaacgttcgaacg

SEQ ID NO: 415619 - DNA, 767 bp, Homo sapiens
  misc_feature: GZ8MTXP01AHELM.8.43.D10.1.454.CMB.2.raw
  modified_base (220)..(220): a, c, t, g, unknown or other
  modified_base (442)..(442): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcactagtgttactactaccaactcgtacagtcaagaacctgacacgacaccagccactgattatagtacaaacaacagactactaccgtacggtacccctcggtaccccgttctaccgacggtcctccccgttccggttccggggaccaaaggtccttaccgcccgtacgacctaacgtgtccgagggtcgtcgacgtacgcccgtaggacggacggngggtacctaggtagttacttactcggtacctcggtccttagttaaagtttcggttggggggggtttacgggttcccggggttttgggggtaccggggttttaccgggggaccgggtaaccggggtaacccgtaaacgggtccggttacccggttaccccgggttaccggttaaccgggttccgtaaccgggacccgtaaaccgggggttccccgtacccgggtcccccccgtttaccggggttcccttcccgggtttccccgtttacccttccccccgttaaccccgttccccgttaccgtaaccccgttcccgggtaacccggg

SEQ ID NO: 415620 - DNA, 681 bp, Homo sapiens
  misc_feature: GZ8MTXP01BDZ8I.8.43.D10.1.454.CMB.2.raw
  modified_base (220)..(220): a, c, t, g, unknown or other
  modified_base (280)..(280): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcaccagtgtacatccaatggttcagcagaactggacagcacccagcactgatttanagtacaaacaactagaccactcctaggaccccctggcccggttctccacggtcctacccgttccgttcgggggtcccaaaggtccgtacgtcccttaacgaccaacttcggtacagggttagtcgcgaacgccgtacgaggtaccggagggtacgtagtagttaacgttacgtacgtaccgtggtaccttcgttatttacggtcgggggttcggggtacggtttcggggttcggtttcggggccggggaacggggtaccgtaacggtcgtccggacccgttccgtaacggtaaccgtacggcccgtaaacgggcccgtaccggtacccccgttccggttccgttacccgtcccgttacggtcccctaacccgtcccgttaaccggccgttccgtaacccgg

SEQ ID NO: 415621 - DNA, 683 bp, Homo sapiens
  misc_feature: GZ8MTXP01AYKYG.8.43.D10.1.454.CMB.2.raw
  modified_base (295)..(295): a, c, t, g, unknown or other
  modified_base (304)..(304): a, c, t, g, unknown or other
  modified_base (332)..(332): a, c, t, g, unknown or other
  modified_base (335)..(335): a, c, t, g, unknown or other
  modified_base (379)..(379): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggagcagtcaccagtggttactactaccaaactcggttccagtcaagaaacctgacaagcacccagcactgatttanagtacaaanacagacactcaggaccctgacccggttnacngctcatccccgtgggacaaagctcgcctgaacacgtgtcaggtntgacacgtccgtgaaggacggtagcgtaggtaagttaacgttcgtacgcccgttacgtactttaccgttagtttacgggtacgggggtttcgggggtaaccccttttgggggggttacggttcccggggacggggaaccggggtaaacccggtaaacgtccggtttaaaaccggcccggtttaaccccggtaaaggggtcccgacggaaccccggttaacggggtcctccggttaacccccgttcgggttacctaaccttaccgtccgttacccccacccgtttacctaacgaacccggaaccg

SEQ ID NO: 415622 - DNA, 605 bp, Homo sapiens
  misc_feature: GZ8MTXP02HH8XR.8.43.D10.1.454.CMB.2.raw
  modified_base (289)..(289): a, c, t, g, unknown or other
  modified_base (330)..(330): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgatttanagtaacaaacaacagacactcctcggacccctgcccgttcncgacgcctccctctcggggaccaaagctgccctgacnctgcagtgtgcagcctagaggacgagctagagttattacgtcgcctgctacttaatttacgttgggtcgggttccgtttgggggttcgggttcgggcgggtaacgggaccgaaggtccgtcggacccgttccgtacgggtaccacggtaccccgaacggtccgtacccggccccccgtcggtacctaccgttcccgtccgttacccccacccttccccgtaccgacccgaccggccgg

SEQ ID NO: 415623 - DNA, 537 bp, Homo sapiens
  misc_feature: GZ8MTXP02ILBLW.8.43.D10.1.454.CMB.2.raw
  modified_base (362)..(362): a, c, t, g, unknown or other
  modified_base (522)..(522): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccaggccactgattatagtacaaacaacagacactcctggacccctgcccgttctcacggctccctctcggggccaaagctgccctgacnctgtcaggtgtgcagcctgaggacgagctggagtattactgcctgctcttattagttggtgggtccgttgggtcggttcggcggagggtaccaaggcgtcggaccgtcgtaggtccacgcccaacggcctcgcccccgtcggtccacgtctcgtaccccncctcctcgacacgcg

SEQ ID NO: 415624 - DNA, 533 bp, Homo sapiens
  misc_feature: GZ8MTXP02GPAT1.8.43.D10.1.454.CMB.2.raw
  modified_base (288)..(288): a, c, t, g, unknown or other
  modified_base (361)..(361): a, c, t, g, unknown or other
  modified_base (401)..(401): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcacccaggccactgatttanagtacaaacaacagacactcctggacccctgcccggttctcagctccctctcggggccaaagctgccctgacnctgtcaggtgtgcagcctgaggacgaggctgagtattacngcctgctctattatgggtgggtccttggggtgtttcgggcgggtagggaccaaggctaggaccgtccgtaggtcacggcccaaacggctcgccccctcggtccactcgtcgttcccgcctcctcgacacgcg

SEQ ID NO: 415625 - DNA, 564 bp, Homo sapiens
  misc_feature: GZ8MTXP02G1NM0.8.43.D10.1.454.CMB.2.raw
  modified_base (282)..(282): a, c, t, g, unknown or other
  modified_base (324)..(324): a, c, t, g, unknown or other
  modified_base (364)..(364): a, c, t, g, unknown or other
  modified_base (412)..(412): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactgtccagcagaactggacaagcaccagccactgattanagtaacaaacaacagacactcctcggacccctgcccggttcncacggcctccctccgttcggggccaaagctcgccctgacnctgtcaggtgtgacagcccgtgacggacggaggctagaagttatacgngcctgctcttattagtgggtcgggtccgttgggtcggtcgggcggacgggaccgaagcgtcgtaccgtcgtacggtcacggacccgaacggccgtccgccccgtcggtccaccgttccgtcgtcccctaccctcccgtccgaccacgaccgg

SEQ ID NO: 415626 - DNA, 517 bp, Homo sapiens
  misc_feature: GZ8MTXP02HWB9A.8.43.D10.1.454.CMB.2.raw
  modified_base (365)..(365): a, c, t, g, unknown or other
  modified_base (437)..(437): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggcctcctccttggggccaaagctgccctgacnctgtcaggtgtgcagcctgagacgagctgagtatactgcctgctctattatggtgggtcttgggtgttcggnggagggaccagctgaccgtctaggtcagcccaggctcgcccctcggtccactcgtcgtcccgccctcctccgactacgcg

SEQ ID NO: 415627 - DNA, 523 bp, Homo sapiens
  misc_feature: GZ8MTXP02IKC8I.8.43.D10.1.454.CMB.2.raw
  modified_base (288)..(288): a, c, t, g, unknown or other
  modified_base (328)..(328): a, c, t, g, unknown or other
  modified_base (364)..(364): a, c, t, g, unknown or other
  modified_base (438)..(438): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctggacaagcaccaggccactgatttanagtacaaacaacagacactcctggacccctgcccggttcncaggcctcctccttcggggccaaagctgccctgacnctgtcaggtgtgcagcctgaggacgagctgagtattactgcctgctctattatggtggtcgttgggtgttcggnggacggaccaagcgtgaccgtcgtaggtcagacccgaaggcctcggcccctcggtcacgtctcgtccccacctcctcgacacgcg

SEQ ID NO: 415628 - DNA, 693 bp, Homo sapiens
  misc_feature: GZ8MTXP02IPPDI.8.43.D10.1.454.CMB.2.raw
  modified_base (197)..(197): a, c, t, g, unknown or other
  modified_base (652)..(652): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactccncactgtctctcagcacgtggacgcagtccaaccgtaggttcggttaactactaaccctaaacgttcggttaccagacaaacgaaaccgtggaacaacgaccaacccgacggaccacgtagtaatttaataagtaaaccaaaaacaaacaacgaacctaacctccgtaccggacccctcggtcccgttctacgacggtccctccccgtccggttccggggaaccaaacgtcgtaccgcccgttacgaacctacgttcgtacgtagggttcgtcgacgacgtcccgtaggacggacggacggtcgtagtaagttacttacgtcgtccgtgtctacttaagttcggttgggtcggttccggttggggttcggttcggggacgggtacgggacgacggcgtacggtacccgtcgtacggtacgaccgaccgaacgtccgtcccgtccccgtcggtaccnccgttccgtccgtcccgtccctaccgtcgaaccgtcgaccg

SEQ ID NO: 415629 - DNA, 535 bp, Homo sapiens
  misc_feature: GZ8MTXP02J0C0U.8.43.D10.1.454.CMB.2.raw
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttcggggccaaagctagccctgacnctgtcagtgtgcagccctgaggacgaggctgagtattactgctgctctattatggtgggtccgttgggtggtttcggcggagggaccaaggctgaccgtcgtaggtcgagcccgaacggcctcgccccctcggtccactcgtcgttcccaccctcctcgaccacgccg

SEQ ID NO: 415630 - DNA, 524 bp, Homo sapiens
  misc_feature: GZ8MTXP02F4G3E.8.43.D10.1.454.CMB.2.raw
  modified_base (290)..(290): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcaggctccctcgttcggggccaaagctcgccctgacnctgtcaggtgtgcagcctgaggacgaggctgagtatactgcctgctctattagtggtgggtccgttgggtggttcggcggagggacaagctgaccgtctaggtcacgccaacggctcgcccctcggccactcgtcgtcccaccctcctcgacacgcg

SEQ ID NO: 415631 - DNA, 531 bp, Homo sapiens
  misc_feature: GZ8MTXP02G07NS.8.43.D10.1.454.CMB.2.raw
  modified_base (289)..(289): a, c, t, g, unknown or other
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtacaaacaacagacactcctggacccctgcccggttctcaggcctccctcgtcggggccaaagctcgccctgacnctgtcaggtgtgcagccctagacgacgaggctgagtattactgcctgctctattagtggtggtccgttgggtcgttcggcggagggaccaagcgtgaccgtcaggtcacgcccaagctcgccccctcggtccactccgtcgtcccacccgtcctacgacacgccg

SEQ ID NO: 415632 - DNA, 599 bp, Homo sapiens
  misc_feature: GZ8MTXP02I185D.8.43.D10.1.454.CMB.2.raw
  modified_base (289)..(289): a, c, t, g, unknown or other
  modified_base (326)..(326): a, c, t, g, unknown or other
  modified_base (362)..(362): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctggacccctgcccgtntcagcctcctcgtcgggaccaagctcgccctgaccncgtgtcgaggtgtcgcacgcccgtagacggacggtaggcgtaggagttacttacgtcgtcctgtcttacttattagtggttcgggtccgttggggtcggttcgggacgggacgggtaccgaacggcgtcggtaccgtccgtacggtaccgacgtacccgaaacggtcccgtaccggcccccgtccggtccaccgttccgtcccgttccccacccctcccgtacccgaccgaccgccg

SEQ ID NO: 415633 - DNA, 553 bp, Homo sapiens
  misc_feature: GZ8MTXP02GW01Z.8.43.D10.1.454.CMB.2.raw
  modified_base (290)..(290): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctgacccctgcccggttctcaggcctccctccgtcggggaccaagctcgccctgacnctgtcaggtgtgcagcctgaggacgagctgagtatactgctgctctattgtggtcggtcgttgggtgttcggcggtagggaccgaagcgtgaccgtcgtacggtcacggaccgaacggtcctcggtcccccgtcggtcctaccgtccgttccgtacccctaccctcccgtaccgaccgacgccgg

SEQ ID NO: 415634 - DNA, 530 bp, Homo sapiens
  misc_feature: GZ8MTXP02HEKMV.8.43.D10.1.454.CMB.2.raw
  modified_base (288)..(288): a, c, t, g, unknown or other
  modified_base (329)..(329): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgattanagtacaaacaacagacaactcctggacccctgcccggttcncagcctccctccttggggccaaagctagccctgacacctgtcaggtgtgcagcctgagacgagctgagtatactgctgctctattagtggtggtccgttgggtggttcggcggaggaccaagctggaccgtcgtaggtcacgcccgaaaggcctcgcccccgtcggtccacgtcgtcgttccccacctcctcgacacgccg

SEQ ID NO: 415635 - DNA, 521 bp, Homo sapiens
  misc_feature: GZ8MTXP02FRMQT.8.43.D10.1.454.CMB.2.raw
  modified_base (365)..(365): a, c, t, g, unknown or other
  modified_base (495)..(495): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttcggggccaaagctgccctgacnctgtcaggtgtgcagcctgaggacgaggctgagtatactgcctgctctattatggtgggccttggggtgttcggcggaggggaccaagctgacgtcaggtcagcccaaggctcgccccctcggtcactcncgttcccacctcctccgacacgccgg

SEQ ID NO: 415636 - DNA, 537 bp, Homo sapiens
  misc_feature: GZ8MTXP02GIDU2.8.43.D10.1.454.CMB.2.raw
  modified_base (289)..(289): a, c, t, g, unknown or other
  modified_base (330)..(330): a, c, t, g, unknown or other
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgatttanagtacaaacaacagacactcctaggaccccctgcccggttntcaggctccctcttcggggccaaagctgccctgacnctgtcaggtgtgcagccctgaggacgaggctgagtattactgcctgctcgtattagtggtgggtccgttggggtcgttcggcgggaggaccaagcgtgaccgtcctagggtcaggcccaaggcctcgccccctcggtcacgtctcgttcccacccgtctaccgacaccgcg

SEQ ID NO: 415637 - DNA, 509 bp, Homo sapiens
  misc_feature: GZ8MTXP02G5YEX.8.43.D10.1.454.CMB.2.raw
  modified_base (289)..(289): a, c, t, g, unknown or other
  modified_base (327)..(327): a, c, t, g, unknown or other
  modified_base (361)..(361): a, c, t, g, unknown or other
  modified_base (371)..(371): a, c, t, g, unknown or other
  modified_base (398)..(398): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctggacccctgcccgttntcagctccctctcggggaccaagctcgcctgacnctgtcaggtntgcagcctgagacgagctgagtatacngctgctctattagtggtggtcgttgggtgtcggcggaggacagctgaccgtcgtaggtcacgccaaggctcgccccgtcgtcacgtctcgtcccacctcgtacgacacgcg

SEQ ID NO: 415638 - DNA, 517 bp, Homo sapiens
  misc_feature: GZ8MTXP02F1IJ8.8.43.D10.1.454.CMB.2.raw
  modified_base (289)..(289): a, c, t, g, unknown or other
  modified_base (362)..(362): a, c, t, g, unknown or other
  modified_base (371)..(371): a, c, t, g, unknown or other
  modified_base (513)..(513): a, c, t, g, unknown or other
tcagctcgcgtgtccacgaccggtgctcgatttagactagcagtaaggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggacccctgcccgttctcagctccctctcggggccaaagctgccctgacnctgcaggtntgcagcctgagacgaggctgagtatactgcctgctctattatggtgggtccttggggtgttcggcggagggaccaagctgaccgtctaggtcagcccaaggctcgcccctcggccactcgtcgttcccaccctcctcgaccncgcg

SEQ ID NO: 415639 - DNA, 512 bp, Homo sapiens
  misc_feature: GZ8MTXP02GW6FH.8.43.D10.1.454.CMB.2.raw
  modified_base (276)..(276): a, c, t, g, unknown or other
  modified_base (349)..(349): a, c, t, g, unknown or other
  modified_base (360)..(360): a, c, t, g, unknown or other
  modified_base (386)..(386): a, c, t, g, unknown or other
  modified_base (390)..(390): a, c, t, g, unknown or other
  modified_base (393)..(393): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgtactatcaaatgtcagcagaactgacaagcaccagccactgattanagtacaaacaacagacactcctggacccctgcccgttctcacgctcctctcgggaccaaagctagccctgacnctgtcagttgngcagcctgagacgagctgagtatacngctnctntatgtggtggtcgtggtggtcggcggaggacagcgtacgaccgtcgtacgtacacgaccgacgccgtccgccccgtcgtcctactccgtccgtacccctaccctccgaccgacgacgcg

SEQ ID NO: 415640 - DNA, 528 bp, Homo sapiens
  misc_feature: GZ8MTXP02H9YU4.8.43.D10.1.454.CMB.2.raw
  modified_base (366)..(366): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgattatagtacaaacaacagacactcctggacccctgcccggttctcaggcctcccctcttcggggccaaagctcgccctgacnctgtcaggtgtgcagcctgaggacgaggctgagtattactgcctgctctattatggtgggtccttggggtgttcggcggagggaccaagctgaccgtcgtaggtcagcccaaggcctcgcccccgtcggtccacgtctcgttccccacctcctcgacacgcg

SEQ ID NO: 415641 - DNA, 591 bp, Homo sapiens
  misc_feature: GZ8MTXP02GIWFA.8.43.D10.1.454.CMB.2.raw
  modified_base (392)..(392): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattatagtacaaacaacagacactcctggacccctgcccgttctcaggctccctccttcggggccaaagctgccctgacactgtcaggtgtgcagcctgagacgagcngagtatactgcctgctctattacgtggtgggtccgttggggttcggtttcggcgggtacggggaccgaaaggtcgtcggtacccgtaccgtagggttaccgacggccccgaaagggtcccgtcggccccccgttccggggtaccctaccgtccgttccggtttaccccctaccccttcccgtcggaaccgacgaacggg

SEQ ID NO: 415642 - DNA, 526 bp, Homo sapiens
  misc_feature: GZ8MTXP02FMY95.8.43.D10.1.454.CMB.2.raw
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggaccccctgccccggttctcaggctcccctccttggggccaaagctgccctgacnctgtcaggtgtgcagcctgaggacgaggctgagtatactgcctgctctattatggtgggccttggggtgttcggcggaggggaccaagctgaccgtcctaggtcagcccaaggctcgccccctcggtcactctcgttccccaccctcctcgacacgcg

SEQ ID NO: 415643 - DNA, 563 bp, Homo sapiens
  misc_feature: GZ8MTXP02FVZ3Q.8.43.D10.1.454.CMB.2.raw
  modified_base (289)..(289): a, c, t, g, unknown or other
  modified_base (364)..(364): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctggacccctgcccggttctcaggctccctcttcggggccaaagctgccctgacnctgtcaggtgtgcagcctgaggacgaggctgagtatactgcctgctctattagtgggtgggtccgttggggtggttcgggcgggtacgggacgaggcgtcggtaccgtcgtacggtcacggacccgacggtccgtccgcccccgttcggtcctaccgtccgttcccgtacccctaccccgtcctaccgaccgacgccgg

SEQ ID NO: 415644 - DNA, 528 bp, Homo sapiens
  misc_feature: GZ8MTXP02HPMXW.8.43.D10.1.454.CMB.2.raw
  modified_base (284)..(284): a, c, t, g, unknown or other
  modified_base (293)..(293): a, c, t, g, unknown or other
  modified_base (359)..(359): a, c, t, g, unknown or other
  modified_base (369)..(369): a, c, t, g, unknown or other
  modified_base (386)..(386): a, c, t, g, unknown or other
  modified_base (388)..(388): a, c, t, g, unknown or other
  modified_base (398)..(398): a, c, t, g, unknown or other
  modified_base (400)..(401): a, c, t, g, unknown or other
  modified_base (404)..(404): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaactggttccagcagaaactggacaagcaccagcactgattanagtacaaanaacagacaactcctggacccctgcccggttctcagcctcctctggggcccaaagctcgccctgacnctgtcaggtntgcagcctgagacgagngngagtatatcncnnctntattagtgtggtcgttggtggtcggcggacggacgacgcgcgacgtcgtacgtacgacgaccgacgcgtccgcccgtccgtcctacctccgtccgtaccctaccctaccgaccgaccgacgacg

SEQ ID NO: 415645 - DNA, 560 bp, Homo sapiens
  misc_feature: GZ8MTXP02JVIKC.8.43.D10.1.454.CMB.2.raw
  modified_base (289)..(289): a, c, t, g, unknown or other
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccaggccactgatttanagtacaaacaacagacactcctggacccctgcccggttctcacggcctcccctcgttcggggaccaaagctcgccctgacnctgtcaggtgtgcagccctgacggacgaggctgagtattactgcctgctctattagtgggtgggtccgtttgggtcggttcgggcggagggtaccaaggctggaccgtcgtaggtcgacgcccgaaggcctcggcccccgtcggtccaccgttccgtccgtttccccgaccctcccgtacgaccacgccg

SEQ ID NO: 415646 - DNA, 521 bp, Homo sapiens
  misc_feature: GZ8MTXP02JI1X5.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctgacccctgcccggttctcaggctccctctcggggccaaagctgcctgacactgtcaggtgtgcagcctgagacgagctgagtatactgcctgctctatactggtggtccttggggtgttcggcggtagggaccaagcgtgaccgtcgtaggtcagcccgaacggctcgcccccgtcggtccactctcgttcccaccctctcgacacgcg

SEQ ID NO: 415647 - DNA, 536 bp, Homo sapiens
  misc_feature: GZ8MTXP02HAVEI.8.43.D10.1.454.CMB.2.raw
  modified_base (287)..(287): a, c, t, g, unknown or other
  modified_base (326)..(326): a, c, t, g, unknown or other
  modified_base (359)..(359): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtggttactatccaaatggttccagcagaaacctggacaagcacccaggccactgattanagtacaaacaacagacactcctggacccctgcccgttcncagcctcctctcgggccaaagctcgccctgacncgtgtcaggtgtgcacgccgtgaggacgagcgtagagtattactcgctgctctattagtggtcggtccgttgggtcggttcggcggacgggaccgaagcgtcggtaccgtcgtacggtcacgcccgaacggcctcgccccgtcggtccactctcgtcccaccctcctcgaccacgcg

SEQ ID NO: 415648 - DNA, 540 bp, Homo sapiens
  misc_feature: GZ8MTXP02GUUS9.8.43.D10.1.454.CMB.2.raw
  modified_base (289)..(289): a, c, t, g, unknown or other
  modified_base (374)..(374): a, c, t, g, unknown or other
  modified_base (491)..(491): a, c, t, g, unknown or other
  modified_base (536)..(536): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccaggccactgatttanagtacaaacaacagacactcctggacccctgcccggttctcgacggtcctccccgtccgttcggggcccaaagctcgccctgacncgtgtcaggtgtgcagcctagaggacgagctgagtattactgctgctctattagtggtcggtcgttgggtgttcggcggaggacgaagcgtgaccgtcgaggtcacgccaacggccncgtcccccgtcggtcctcgtcgtccgtcccgccctccgtccgacncgcg

SEQ ID NO: 415649 - DNA, 555 bp, Homo sapiens
  misc_feature: GZ8MTXP02GXQVE.8.43.D10.1.454.CMB.2.raw
  modified_base (288)..(288): a, c, t, g, unknown or other
  modified_base (364)..(364): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgattanagtacaaacaacagacactcctggacccctgcccggttctcaggcctccctctcggggccaaagctcgccctgacnctgtcaggtgtgcagcctgaggacgaggctgagtatactgcctgctctattagtggtgggtccgttggggtgttcgggcgggtagggaccaaggcgtcggaccgtccgtacggtcacggcccgaacggtccgtaccggcccccgtcggtcctaccgtcctcgttccccaccctcccgtccgaccacgccgg

SEQ ID NO: 415650 - DNA, 585 bp, Homo sapiens
  misc_feature: GZ8MTXP02FT7UI.8.43.D10.1.454.CMB.2.raw
  modified_base (291)..(291): a, c, t, g, unknown or other
  modified_base (370)..(370): a, c, t, g, unknown or other
  modified_base (414)..(414): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcaagaaacctagacaagcacccaggccactgtattanagtaacaaacaacagacactcctcggacccctgcccggttctcacggcctcctcgttcgggaccaagctcgccctgacnctgtcgaggtgtgcagcctgacggacgagctgaagttattacgngtcctgctattattagtggtcgggtccgtttggggtcggttcgggcggtacgggactaacggtcgtacgacccgtcgtacggtcacggacccgaacggtcctccgtcccccgtacggtccgtacctccgttcccgttaccccgacccctccgtaccgaccgtaccgaccgg

SEQ ID NO: 415651 - DNA, 593 bp, Homo sapiens
  misc_feature: GZ8MTXP02JX1Z6.8.43.D10.1.454.CMB.2.raw
  modified_base (289)..(289): a, c, t, g, unknown or other
  modified_base (376)..(376): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgatttanagtaacaaacaacagacactcctcggacccctgcccggttctcgacggtcctccccgtcgttcggggaccaaagctacgccctgacncgtgtcaggtgtcgcacgccgtagaggacgaggctagagttattacgtgtcctgtcttacttagttagtgggttcgggtccgttggggtggttcggacgggaggaccgagcgtcggaccgtcgtaggtccgacgcccgaacggtcctccggcccccgtccggtcctaccgttccgtcccgttcccccaccccgttcccgtaccgacccgacgcccgg

SEQ ID NO: 415652 - DNA, 596 bp, Homo sapiens
  misc_feature: GZ8MTXP02GH59T.8.43.D10.1.454.CMB.2.raw
  modified_base (287)..(287): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagcactgatttanagtacaaacaacagacactcctcggacccctgcccggttctcaggcctccctcgttcggggaccaaagctcgccctgacnctgtcaggtgtgcagcctgagacgagctgagtatactgcctgctctattacgtgggttcgggtccgttggggtggtttcgggcggggtaacggggaccaaaggtcgtacggaccgttccgtaaggttccgacggtacccgaaacgggtccgtcggccccccgtccgggtacctaccgttccgttccggtttcccccaccccttcccgtacccgaaccgtaccggaccgg

SEQ ID NO: 415653 - DNA, 539 bp, Homo sapiens
  misc_feature: GZ8MTXP02GXZYA.8.43.D10.1.454.CMB.2.raw
  modified_base (290)..(290): a, c, t, g, unknown or other
  modified_base (365)..(365): a, c, t, g, unknown or other
  modified_base (504)..(504): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagatactcctggacccctgcccggttctcagctccctcttcggggccaaagctcgccctgacnctgtcaggtgtgcagcctgaggacgaggctgagtattactgcctgctctattatggtggccgttgggtggttcggcggagggaccgaaggctcggaccgtcgtaggtcacgcccgaaggtcctcgcccccgtcggtccnccgtcgtccgttcccaccctcctccgaccacgccg

SEQ ID NO: 415654 - DNA, 543 bp, Homo sapiens
  misc_feature: GZ8MTXP02G1GGQ.8.43.D10.1.454.CMB.2.raw
  modified_base (289)..(289): a, c, t, g, unknown or other
  modified_base (361)..(361): a, c, t, g, unknown or other
  modified_base (400)..(400): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctggacccctgcccggttctcagctcctctcggggccaaagctgccctgacnctgtcaggtgtgcagcctgaggacgagctgagtataccngcctgctctattagtggtgggtccttgggtcgttcggcggaggaccgaagctcgaccgtcgtaggtcacgccgaaggccgtcgcccccgtcggtcctaccgtccgttcgttccccgccccttcccgtccgaccgaaccgccgg

SEQ ID NO: 415655 - DNA, 520 bp, Homo sapiens
  misc_feature: GZ8MTXP02JFEOK.8.43.D10.1.454.CMB.2.raw
  modified_base (401)..(401): a, c, t, g, unknown or other
  modified_base (476)..(476): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcagctcctctcggggccaaagctgccctgacactgcaggtgtgcagccctgaggacgaggctgagtatacngcctgctctattatggtgggtccttgggtgttcgggcggtagggaccaaggctgaccgtcaggtcagccaaggcncgcccctcggtccactcgtcgttcccacctcctccgacacgccg

SEQ ID NO: 415656 - DNA, 599 bp, Homo sapiens
  misc_feature: GZ8MTXP02FX4G0.8.43.D10.1.454.CMB.2.raw
  modified_base (290)..(290): a, c, t, g, unknown or other
  modified_base (371)..(371): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcacggcctccctccgttcggggaccaaagctcgccctgacnctgtcaggtgtcgctagcctgaggacgagctgagtatactgcctgctctattagtgggtcgggtcgttgggtgttcgggcggtaggaccaaggcgtacggaccgtccgtaggtacgacggcccgaaacgggtcctccggtccccccgttccgggttcccaacccgttccgttcccggtttaccccctacccccttcccccgttacccggaacccgtaaccggcccggg

SEQ ID NO: 415657 - DNA, 526 bp, Homo sapiens
  misc_feature: GZ8MTXP02HZLZU.8.43.D10.1.454.CMB.2.raw
  modified_base (288)..(288): a, c, t, g, unknown or other
  modified_base (365)..(365): a, c, t, g, unknown or other
  modified_base (444)..(444): a, c, t, g, unknown or other
  modified_base (447)..(447): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaacctggacaagcacccaggccactgatttanagtacaaacacagacactcctcggacccctgcccggttctcagcctccctcgttcggggccaaagctcgccctgacncgtgtcaggtgtgcagccctgaggacgaggctgagtattacgtgcctgctctattagtggtggtcgttgggtgttcggnggnggacagcgtgacgtcgtacggtcacgcccaggccgtcgccccgtcggtccactcgtcgtcccaccctcctcgacacgcg

SEQ ID NO: 415658 - DNA, 519 bp, Homo sapiens
  misc_feature: GZ8MTXP02IV4CM.8.43.D10.1.454.CMB.2.raw
  modified_base (288)..(288): a, c, t, g, unknown or other
  modified_base (358)..(358): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccagccactgatttanagtacaaacaacagacactcctgacccctgcccgtctcagctccctcttggggccaaagctgccctgacnctgtcaggtntgcagccctgaggacgaggctgagtattactgcctgctctattagtggtgggtccttgggtgttcggcggagggaccagctgaccgtcgtacggtcagcccaaggctcgcccctcggtccactcgtcgtcccgtccctctccgacacgccg

SEQ ID NO: 415659 - DNA, 546 bp, Homo sapiens
  misc_feature: GZ8MTXP02I7DJZ.8.43.D10.1.454.CMB.2.raw
  modified_base (290)..(290): a, c, t, g, unknown or other
  modified_base (369)..(369): a, c, t, g, unknown or other
  modified_base (380)..(380): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcaggcctccctccgttcggggccaaagctcgccctgacnctgtcaggtgngcagcctgaggacgaggctgagtattactgcctgctctattagtgggtggtccgttgggtgttcggcggagggaccaggctcggaccgtcgtacggtcacggcccgaagggcctccgcccccgtcggtccacgtccgtcgtccccgccctccgtcgaccacggccg

SEQ ID NO: 415660 - DNA, 563 bp, Homo sapiens
  misc_feature: GZ8MTXP02GHBBT.8.43.D10.1.454.CMB.2.raw
  modified_base (290)..(290): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccaggctccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcaggcctccctcccgttcggggcctaaaagcctacgcccctgaccactgtcaggtgtcgcagcctgaggacgaggctgagtatactgcctgctctattagtggtggtccgttggggtgttcggcggtaggaccgaagcgtgaccgtccgtacggtcacggcccgtaaaggccgtccgcccccgtcggtaccaaccgttcctacgttcccccaccctccgtaccgtacacccgg

SEQ ID NO: 415661 - DNA, 573 bp, Homo sapiens
  misc_feature: GZ8MTXP02JRTI5.8.43.D10.1.454.CMB.2.raw
  modified_base (363)..(363): a, c, t, g, unknown or other
  modified_base (405)..(405): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaactggttccagcagaaacctggacaagcacccaggccactgatttatagtacaaacaacagacactcctggacccctgcccgttctcaggcctccctctcggggccaaagctgccctgacnctgtcaggtgtgcagccctgaggacgaggctagagtattacngccctgctctattagtggtgggtccgtttggggtcggttcgggcgggaggggtacccgaaggtccgtacggtacccgtccgtacgggtccgacggccccgaaggccgtccggcccccgtcgggtccacgttccgtcgttcccccaccctcccgtccgaccaccgccgg

SEQ ID NO: 415662 - DNA, 531 bp, Homo sapiens
  misc_feature: GZ8MTXP02HDJZ2.8.43.D10.1.454.CMB.2.raw
  modified_base (289)..(289): a, c, t, g, unknown or other
  modified_base (362)..(362): a, c, t, g, unknown or other
  modified_base (401)..(401): a, c, t, g, unknown or other
  modified_base (480)..(480): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtacaaacaacagacactcctggacccctgcccggttctcagctccctctcggggccaaagctgccctgacnctgtcaggtgtgcagcctgaggacgagctgagtattacngcctgctctattatgggtggccgttgggtgtttcggcggaggaccgaagcgtgaccgtctacggtcacgcccaaggccncgcccccgtcggtcctaccgtcgtccgttcccaccctcctccgaccacgcg

SEQ ID NO: 415663 - DNA, 536 bp, Homo sapiens
  misc_feature: GZ8MTXP02IEZCA.8.43.D10.1.454.CMB.2.raw
  modified_base (182)..(182): a, c, t, g, unknown or other
  modified_base (290)..(290): a, c, t, g, unknown or other
  modified_base (490)..(490): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggngggacagtcactctcacctgtgcttccagcactggagcagtcaccagtggttactatccaaactggttccagcagaaacctggacaagcacccaggccactgatttanagtacaaacaacagacactcctcggacccctgcccgttctcaggcctccctccttcggggccaaagctcgccctgcactggtcaggtgtgcagcctgaggacgaggctgagtatactgctgctctattagtggtcgggtcttaggggtgttacgggcggtagggaccaaggctggaccgtcgtaggtcagcccgaaggcnccgcccctcggtccacgtcgtcgttcccaccctcctcgacacgccg

SEQ ID NO: 415664 - DNA, 524 bp, Homo sapiens
  misc_feature: GZ8MTXP02IHHZA.8.43.D10.1.454.CMB.2.raw
  modified_base (284)..(284): a, c, t, g, unknown or other
  modified_base (374)..(374): a, c, t, g, unknown or other
  modified_base (476)..(476): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactggagcagtcaccagtggttactatccaaactggtccagcagaactggacaagcacccagccactgattanagtacaaacaacagacactcctggacccctgccccgttctcacgcctccctccttcggggacccaaagctgccctgacactgtcaggttntgcagcctgaggacgaggctgagtatactgctgctctattagtggtgggtcgttgggtgttcggcggaggacagctgaccgtcgtaggtcagcccgaggccncgcccccgtcggtccacctcgtcgtcccaccctcctccgacaccgtcg

SEQ ID NO: 415665 - DNA, 541 bp, Homo sapiens
  misc_feature: GZ8MTXP02GK39Q.8.43.D10.1.454.CMB.2.raw
  modified_base (290)..(290): a, c, t, g, unknown or other
  modified_base (369)..(369): a, c, t, g, unknown or other
  modified_base (410)..(410): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctcgacccctgcccggttctcaggcctccctcgttcggggccaaagctcgccctgacnctgtcaggtgtgcagccctgaggacgaggctgagtattacngcctgctctattagtggtggtccgttgggtgttcgggcggagggtaccagctgaccgtcgtagtcacgccgaacggcctccgcccctcggtccaccgtcgtccgttccccgcccttccgtcgacctacgcg

SEQ ID NO: 415666 - DNA, 570 bp, Homo sapiens
  misc_feature: GZ8MTXP02H6KD5.8.43.D10.1.454.CMB.2.raw
  modified_base (253)..(253): a, c, t, g, unknown or other
  modified_base (316)..(316): a, c, t, g, unknown or other
  modified_base (358)..(358): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttacatccaatgtcagcagaacngacagcaccagccactgattatagtacaaacaacagacactcctggacccctagcccggttcncacggtcctacccctcttccggggccaaaagctgtcctgacnctgtcaggtgtgcagccctgaggacgagctagagtattactcgctagctctattagtggtcggtcgttgggtggttcgggtggacgggaccgtaagcgtacgaccgtacgtacggtcgacggcccgaaacggccgtccgccccccgtcgggtcctaccgttccgttaccggttccccctacccctcccgttcccgaaccgtaaccggcccgg

SEQ ID NO: 415667 - DNA, 513 bp, Homo sapiens
  misc_feature: GZ8MTXP02IYC3I.8.43.D10.1.454.CMB.2.raw
  modified_base (291)..(291): a, c, t, g, unknown or other
  modified_base (300)..(300): a, c, t, g, unknown or other
  modified_base (361)..(361): a, c, t, g, unknown or other
  modified_base (371)..(371): a, c, t, g, unknown or other
  modified_base (401)..(401): a, c, t, g, unknown or other
  modified_base (509)..(509): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaanaacagacactcctggacccctgcccgttctcagctccctcttgggccaagctgccctgacnctgtcaggtntgcagcctgaggacgaggctgagtattacngcctgctctattactggtggtccttggggtgttcgggcggagggacaagctgactcgtagtcagccaggcctcgccccgtacgtcacgtctcgtcccacctctcgacncgcg

SEQ ID NO: 415668 - DNA, 614 bp, Homo sapiens
  misc_feature: GZ8MTXP02GP1L8.8.43.D10.1.454.CMB.2.raw
  modified_base (214)..(214): a, c, t, g, unknown or other
  modified_base (283)..(283): a, c, t, g, unknown or other
tcagctcgcgtgtccacgaccggtgctcgatttagactagcagtaaggggcgccagggtccttccaatatcagcaccatggcctggactcctctctttctgttcctcctcacttgctgcccagggtccaattctcagactgtggtgactcaggagcctcactgactgtgtcccaggagggacagtcactctcacctgtgcttccagcactggancagtcaccagtggtactatccaaactggttccagcagaaacctggacaagcaccaggccactgatttanagtacaaactacagacactcctggacccctgccggttctcaggctcctctcgggccaaagctgccctgactctgtcaggtcgtgcagcctgagacgagctagagtattacgtagcctagctacgtattacgtggtacgggtcctttggggtcgtttcgggccggtaacggggtacctaaacggtccgttacggtacccggttaccgtaacgggttccgtaacgggtacccgtaaacgggtcccgttaacggtccccccgttaacggggtcctaaccgttccgttaccggttccccgtacccgttacccgtcggtaacctaaccggttccgg

SEQ ID NO: 415669 - DNA, 517 bp, Homo sapiens
  misc_feature: GZ8MTXP02G74YG.8.43.D10.1.454.CMB.2.raw
  modified_base (372)..(372): a, c, t, g, unknown or other
  modified_base (407)..(407): a, c, t, g, unknown or other
  modified_base (483)..(483): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctctgggccaaagctgccctgacactgcaggtgngcagcctgagacgagctgagtatactgcctgcttntattagtggtggtcgttgggtggtggcggaggacagctcgaccgtcgtagcacgaccacggctcgccccgtcgtcncctcgtccgttccccgccctcctcgaccgacgcg

SEQ ID NO: 415670 - DNA, 523 bp, Homo sapiens
  misc_feature: GZ8MTXP02FXBMG.8.43.D10.1.454.CMB.2.raw
  modified_base (289)..(289): a, c, t, g, unknown or other
  modified_base (298)..(298): a, c, t, g, unknown or other
  modified_base (369)..(369): a, c, t, g, unknown or other
  modified_base (379)..(379): a, c, t, g, unknown or other
  modified_base (514)..(514): a, c, t, g, unknown or other
  modified_base (519)..(519): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggtactatccaaactggttccagcagaaacctggacaagcacccaggccactgatttanagtacaaanaacagacactcctggaccccctgccccggttctcacggcctcccctctcggggccaaagctcgccctgacnctgcaggtgngcagcctgagacgagctagagtatactgcctgctctattactgggtcggccgttggggtggttcggcggagggaccaaggctggaccgtccgaggtcagccaaggctcgcccctcgcactcgtcgtcccacctcncgacncgcg

SEQ ID NO: 415671 - DNA, 555 bp, Homo sapiens
  misc_feature: GZ8MTXP02JAFBD.8.43.D10.1.454.CMB.2.raw
  modified_base (309)..(309): a, c, t, g, unknown or other
  modified_base (324)..(324): a, c, t, g, unknown or other
  modified_base (358)..(358): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccaggccactgattatagtacaaacaacagacactcngacccctgcccgtcncagctccctctcgggccaaagctcgccctgaccnctgtcagggtgtcgcacgcccgtgacggacgtaggctagagtattacgtgcctgctcttattagtgggtgggtccgtttggggtgttcgggcggtagggaccaagcgtggaccgtcgtaggtccgacgtcccgaacggcctaccggcccccgtcggtccactccgtcgttccccacccgtcctaccgacgacgccgg

SEQ ID NO: 415672 - DNA, 564 bp, Homo sapiens
  misc_feature: GZ8MTXP02GK7TV.8.43.D10.1.454.CMB.2.raw
  modified_base (292)..(292): a, c, t, g, unknown or other
  modified_base (379)..(379): a, c, t, g, unknown or other
  modified_base (407)..(407): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagcccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctcggacccctgccccggttctcacggcctcccctccgttccggggaccaaagctcgccctagacnctgtcaggtgtcgcagcctgacggacgnggctgagtatactgcctgctctagttagtggtggtcgttgggtgttcggcggagggacagcgtcgaccgtcgtaggtcacggcccaacggcctccgtcccccgtcggtcctacctccgttccgttcccccaccccttcccgtaccgaccgacgccgg

SEQ ID NO: 415673 - DNA, 514 bp, Homo sapiens
  misc_feature: GZ8MTXP02HVGHD.8.43.D10.1.454.CMB.2.raw
  modified_base (364)..(364): a, c, t, g, unknown or other
  modified_base (374)..(374): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctgacccctgcccgttctcagcctcctccttcggggccaaagctcgccctgacnctgtcaggtntgcagcctgagacgagctgagtattactgcctgctctattagtggtgggtcttgggtgttcggcggaggacaagctgaccgtctaggtcacgccaacgctcgccccgtcgtcacgtctcgtcccacctcctcgacacgcg

SEQ ID NO: 415674 - DNA, 521 bp, Homo sapiens
  misc_feature: GZ8MTXP02HH8PY.8.43.D10.1.454.CMB.2.raw
  modified_base (219)..(219): a, c, t, g, unknown or other
  modified_base (346)..(346): a, c, t, g, unknown or other
  modified_base (515)..(515): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgttacatcaaactgtcagcagaactgacagcaccagcactgattatagtacaaacaacagacactcctggacccctgcccgttctcagctcctcctcgggccaaagctgccctgacnctgtcaggtgtgcagcctgagacgagctgagtattactgctgctctattacgtggtgggtccgttgggtggttcggcgggacgggacgaagcgtcgaccgtcgtacgtcgacgacccgaacggcgtccgccccgtcgtccacctcgtcgttcccaccctccgtccgacncgaccg

SEQ ID NO: 415675 - DNA, 594 bp, Homo sapiens
  misc_feature: GZ8MTXP02JFIN8.8.43.D10.1.454.CMB.2.raw
  modified_base (219)..(219): a, c, t, g, unknown or other
  modified_base (289)..(289): a, c, t, g, unknown or other
  modified_base (326)..(326): a, c, t, g, unknown or other
  modified_base (355)..(355): a, c, t, g, unknown or other
  modified_base (359)..(359): a, c, t, g, unknown or other
  modified_base (401)..(401): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggttccagcagaaacctggacaagcacccaggccactgattanagtaacaaacaacagacactcctggacccctgccgtntcagctccctctcgggccaaagctgcccngacnctgtcgaggtgtgcagcctgagacggaggctgagttattacngtacctgctcttaattacgtgggtcgggtccgtttggggtcggttcgggtacgggagggacccgaaggtcgtacggacccgtccgtacggttccgacgacccgtaaacgggccgtccggccccccgttcgggtacctaccgttccgttccggtttcccccgccccgtccccgttaccgacccgtacggcccgg

SEQ ID NO: 415676 - DNA, 549 bp, Homo sapiens
  misc_feature: GZ8MTXP02HYFTY.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacacagaacactcctggacccctgccggttctcaggcctccctcttcggggccaaagctacgccctagaccacgtgtcaggtcgtgcagccctgaggacgaggctgagttatactgctgctctattactggtcggtcgttggggttgttcgggcggaggaccaagctggtaccgtcgtaggtcgacgtccgaaacggtctacgcccccgtacggtcctacgtcctacgtcccctaccctctaccgctacgcg

SEQ ID NO: 415677 - DNA, 582 bp, Homo sapiens
  misc_feature: GZ8MTXP02H96XX.8.43.D10.1.454.CMB.2.raw
  modified_base (282)..(282): a, c, t, g, unknown or other
  modified_base (322)..(322): a, c, t, g, unknown or other
  modified_base (359)..(359): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaatggtccagcagaactggacaagcaccagccactgattanagtacaaacaacagacactcctggacccctgcccggttcncacggcctccctctcggggccaaagctcgccctgacnctgtcaggtgtgcagcctgaggacgaggctaggagttattactgcctgctctattagtgggtgggtccgtttggggtggttcgggcgggaacggggaccgaaggcgttaggacccgttccgtacggtacacggtcccgaaacggtcctccggcccccgtcggtccctaccgttcccgttccggttcccccacccgttcccgttacccgaccgaccggacccgg

SEQ ID NO: 415678 - DNA, 679 bp, Homo sapiens
  misc_feature: GZ8MTXP02JQ0PH.8.43.D10.1.454.CMB.2.raw
  modified_base (284)..(284): a, c, t, g, unknown or other
  modified_base (374)..(374): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggtcagcagaacctggacaagcacccagccactgatttanagtaacaaacaacagacactcctcggacccctcgtcccggttctcgacggtcctcccgtccgttaccggggaccaaagctcgccctgacncgtcgtacgaggtgtcgcgacgcccgtaggacggaccggaggacgtggtaagttattaccgtcggtcctgtccttacgtttaagtttaggttggggttcggggtcccggtttgggggttcgggtttccggggacggggtaacggggtaacccgtaaaggtccgtacggtaccccggtaccgtaacgggttccgaacggaccccggaaacgggtcccgtcccggtccccccgttccgggttccctaacccggttccgttcccggttcccccgtccccgttcccgtcccgaacccggccgacccggg

SEQ ID NO: 415679 - DNA, 560 bp, Homo sapiens
  misc_feature: GZ8MTXP02G1U9M.8.43.D10.1.454.CMB.2.raw
  modified_base (363)..(363): a, c, t, g, unknown or other
  modified_base (405)..(405): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccagccactgattatagtacaaacaacagacactctcggacccctgcccggttctcagtcctccctcgtcgggccaaagctcgccctgacnctgtcaggtgtgctacgccctgaggacgaggctgagtatacngcctgctctattagtggtcgggtccgttgggtcggttcggacgggaggaccgaagcgtacgaccgtcgtacggtcacggtacccaacggtcctccggtcccccgtcggtcctaccgtccgttcggttcccctaccctcctccgaccgaccgccgg

SEQ ID NO: 415680 - DNA, 589 bp, Homo sapiens
  misc_feature: GZ8MTXP02JXQA3.8.43.D10.1.454.CMB.2.raw
  modified_base (219)..(219): a, c, t, g, unknown or other
  modified_base (278)..(278): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgtactatcaactgtccagcagaactggacaagcaccagccactgattanagtacaaacaacagacactcctggacccctgcccgttctcaggcctccctcgtcggggccaaagctcgccctgactctgtcaggtgtacgcgagcccgtagacggacggaggcgtagagtattacgtgtccctgtcttactagttagtgggtcgggtccgttgggttcggttcgggcgggacgggacgtaacggcgtacggtacccgtcgtacggtccgacggtacccgaacgggtcctccggtcccccgtcggttcctaccgttccgttccgttacccccgtccctcccgtaccggaccgaccggtccgg

SEQ ID NO: 415681 - DNA, 537 bp, Homo sapiens
  misc_feature: GZ8MTXP02FZOY5.8.43.D10.1.454.CMB.2.raw
  modified_base (288)..(288): a, c, t, g, unknown or other
  modified_base (365)..(365): a, c, t, g, unknown or other
tcagctcgcgtgtccacgaccggtgctcgatttagactagcagtaaggggcgccagggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggaccccctgccccggttctcaggctccctccttggggccaaagctgccctgacnctgtcaggtgtgcagccctgaggacgaggctgagtatactgcctgctctattatggtgggtccgttggggtggttcgggcggtagggaccgaaggctaggaccgtccgtaggtcaggcccaaggcctcgcccccgtcggtcaccgtctcgttcccaccctcctcgacacgcg

SEQ ID NO: 415682 - DNA, 585 bp, Homo sapiens
  misc_feature: GZ8MTXP02I9C29.8.43.D10.1.454.CMB.2.raw
  modified_base (283)..(283): a, c, t, g, unknown or other
  modified_base (322)..(322): a, c, t, g, unknown or other
  modified_base (359)..(359): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatccaactggtcagcagaacctggacaagcacccaggccactgattanagtacaaacaacagacactcctcggacccctgcccgttncacgcctcctcgtcggggaccaaagctcgccctgacncgtgcaggtctgcagcctgacggacgaggcgtagagtacttacgcgtcctgactcttagttagtgggtggtcccgttggtcggttggttcgggcggacgggtaccgaagcgtcggaccgtccgtacggtccacggcccgaaaggcccgtaccgtcccccgtcggtaccctaaccgtcccgttaccggttacccccacccgttcccgtacccggaaccgtacccggg

SEQ ID NO: 415683 - DNA, 548 bp, Homo sapiens
  misc_feature: GZ8MTXP02JOHRD.8.43.D10.1.454.CMB.2.raw
  modified_base (373)..(373): a, c, t, g, unknown or other
  modified_base (417)..(417): a, c, t, g, unknown or other
  modified_base (535)..(535): a, c, t, g, unknown or other
  modified_base (543)..(543): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcacccaggccactgatttatagtaacaaaacaacagaacactcctggacccctgccccggttctcaggtcctccctccttcggggccaaaagctcgccctgacnctgtcagggtgtgcacgcctgaggaccgaggctgacgtattacngccctgactctattagtggtcgggtcttgggtggttcggcggagggaccaagcgtgaccgtctaggtcacgcccgaaggcctccgcccctcggtccacctcgtcgttccccacctccnccgtaacnccgcg

SEQ ID NO: 415684 - DNA, 578 bp, Homo sapiens
  misc_feature: GZ8MTXP02GOI1X.8.43.D10.1.454.CMB.2.raw
  modified_base (287)..(287): a, c, t, g, unknown or other
  modified_base (327)..(327): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaacctggacaagcacccaggccactgatttanagtacaaacacagacactcctggacccctgccccggttcncgacggcctccctcgttcggggccaaagctaggccctgacnctgtcaggtgtgcagccctgaggacgaggcgtgagttattactgcctgcctcttattagtgggtcgggtccgttggggtcggttcgggcggtacgggaccgaagtcgtcggaccgtcgttaacggccgacgcccgaacggtcctccggtcccccgtcggtcctaccgtccgttcccgttcccctacccgtccgtaccgaccaccggccgg

SEQ ID NO: 415685 - DNA, 566 bp, Homo sapiens
  misc_feature: GZ8MTXP02HHIYB.8.43.D10.1.454.CMB.2.raw
  modified_base (290)..(290): a, c, t, g, unknown or other
  modified_base (378)..(378): a, c, t, g, unknown or other
  modified_base (418)..(418): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctcggacccctgccccggttctccacggtcctccccgtccttcggggacccaaagcctcgccctgacnctgtcaggtgtgcagcctgaggacgaggctgagtattacngctgctctattagtggtggtccgttgggtggttcgggcggagggtaccgaagcgtacgaccgtcgtacggtcgacgcccgaacggcctccggcccccgtcgggtcccaccgtccgtcgttcccccaccctccctccgaccgacgccgg

SEQ ID NO: 415686 - DNA, 522 bp, Homo sapiens
  misc_feature: GZ8MTXP02IRC00.8.43.D10.1.454.CMB.2.raw
  modified_base (367)..(367): a, c, t, g, unknown or other
  modified_base (408)..(408): a, c, t, g, unknown or other
  modified_base (455)..(455): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggcctccctccttcggggccaaagctgccctgacnctgtcaggtgtgcagccctgaggacgaggctgagtattacngctgctctattagtggtggccgttgggtgttcggcggaggacaagcngaccgtcgaggtcacgccgaacgctcgccccgtcggtcactcgtcgtcccaccctcctcgacacgcg

SEQ ID NO: 415687 - DNA, 578 bp, Homo sapiens
  misc_feature: GZ8MTXP02JU1YL.8.43.D10.1.454.CMB.2.raw
  modified_base (288)..(288): a, c, t, g, unknown or other
  modified_base (366)..(366): a, c, t, g, unknown or other
  modified_base (376)..(376): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcaccaggccactgatttanagtacaaacaacagacactcctcggacccctgccccggttctcaggcctccctcgtcggggccaaagctgccctgacnctgtcaggtntgcagcctgaggacgaggctgagtatactgctgctctattagtggtgggtccgttggggtcgttcgggcggaggggtaccgaaggtcgtcggaaccgtccgtaacggtccgacggtcccgaacgggtccttccggcccccgttacgggtccctaccgtccgttccgttaccccgtacccctcccgtaccgaccgaccgccgg

SEQ ID NO: 415688 - DNA, 557 bp, Homo sapiens
  misc_feature: GZ8MTXP02F9S4J.8.43.D10.1.454.CMB.2.raw
  modified_base (288)..(288): a, c, t, g, unknown or other
  modified_base (330)..(330): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgattanagtaacaaacaacagacactcctcggacccctgcccggttcncgaggcctcccctccgttcggggcccaaagctcgccctgacnctgtcaggtgtgcacgcctgaggacgaggctgagtattactgcctgctctattagtgggtgggtccgtttggggtcggttcggcgggtagggaccaaggcgtcgaccgtccgtaggtcacggcccgaacggcctcgcccccgtcggtcctactcgttcgtccccaccctcctacgaccacgacgg

SEQ ID NO: 415689 - DNA, 517 bp, Homo sapiens
  misc_feature: GZ8MTXP02JCE46.8.43.D10.1.454.CMB.2.raw
  modified_base (288)..(288): a, c, t, g, unknown or other
  modified_base (366)..(366): a, c, t, g, unknown or other
  modified_base (394)..(394): a, c, t, g, unknown or other
  modified_base (403)..(403): a, c, t, g, unknown or other
  modified_base (466)..(466): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaaacctggacaagcacccaggccactgatttanagtacaaacaacagacactcctcggacccctgcccggttctcacgcctccctcgtcggggccaaagctcgccctgacnctgtcaggtgtgcagcctgagacgagcngagtatacngcctgctctatgtggtcgggtcttgggtgttcggcggaggacaagcgtgaccgtctcggtacngacccaggcctcgcccctcgccactcgcgttcccaccgtccacgacacgcg

SEQ ID NO: 415690 - DNA, 650 bp, Homo sapiens
  misc_feature: GZ8MTXP02IRQOW.8.43.D10.1.454.CMB.2.raw
  modified_base (286)..(286): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaaacctggacaagcaccagccactgatttanagtaacaaacaacagacactcctacggaccccctgccccggttctccgacggtcctccccgtccgttcggggacccaaagcctacgccctagaccacttgtaccaggttgtcgcagcccgtggacggacggagcgtagagtaattactgcctagccttactatttagtcgggttgggttccgttggggttcggttcgggacgggacgggtaaccgtaaacggctacggtacccggttaccgtaacgggtccaaccgggtcccgtaaacgggtccctaccggtcccccccgttacgggtccctaaccgttccgtttccggttacccccttaaccccttcccgtacccggaccgtaaccggcccgg

SEQ ID NO: 415691 - DNA, 530 bp, Homo sapiens
  misc_feature: GZ8MTXP02FGJKE.8.43.D10.1.454.CMB.2.raw
  modified_base (290)..(290): a, c, t, g, unknown or other
  modified_base (367)..(367): a, c, t, g, unknown or other
  modified_base (419)..(419): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggaccccctgccccggttctcaggctcccctctcggggccaaagctgccctgacnctgcaggtgtgcagcctgaggacgaggctgagtatactgctgctctattagnggtgggtccgttgggtggttcggcggagggaccaagctgaccgtcgtaggtcagcccaaggctcgccccctcggccacgtcctcgttccccaccctcctaccgacacgccg

SEQ ID NO: 415692 - DNA, 654 bp, Homo sapiens
  misc_feature: GZ8MTXP02G2N1N.8.43.D10.1.454.CMB.2.raw
  modified_base (297)..(297): a, c, t, g, unknown or other
  modified_base (319)..(319): a, c, t, g, unknown or other
  modified_base (334)..(334): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccagcacgtggagcagtcaccagttggttactataccaaactggttccagcaagaaacctggacaagccacccaggccactgtattaanagtaacaaacaacagacactcncgaccctcgcccgtncagcctcctcgtcgggacaagctcgccctgacnctgtcaggtgtcgcagccgtagaggacgaggcgtagtagttattacgtcgccgtgtacttacgttattacggtgggttcgggtccgtttggggttcgggttacgggacgggtacgggaaccgtacggtccgtaccggtaccggttaccggtacggttaccgaccggaccccggtaaacgggtcccgttaccccggtccccccgttaccgggtccctaccgttcccggttaccccgttacccccgttaccccctccccgttacccggaaccggtaacccggtacccgg

SEQ ID NO: 415693 - DNA, 564 bp, Homo sapiens
  misc_feature: GZ8MTXP02H01HK.8.43.D10.1.454.CMB.2.raw
  modified_base (278)..(278): a, c, t, g, unknown or other
  modified_base (319)..(319): a, c, t, g, unknown or other
  modified_base (365)..(365): a, c, t, g, unknown or other
  modified_base (378)..(378): a, c, t, g, unknown or other
  modified_base (410)..(410): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttacatccaatgtccagcaagaacctgacaagcaccagcactgattanagtaacaaacaacagacactcctggacccctgcccgtttcncgaacggtcctcccctcttccggggaccaaaagctacgccctgacncgtgtcaggtgtncgagcctagacggacgagctagagtattacgngtactgcttactagttagtggttgggtcgtttggggtcgttcgggcggagggaccaaggctaggaccgtcgtacgtcgaacggccgaaacggtctaccgcccccgtcgtaccgtccgtccgtcggtcccctccctccgtacccacgacgaccgg

SEQ ID NO: 415694 - DNA, 549 bp, Homo sapiens
  misc_feature: GZ8MTXP02G4CJE.8.43.D10.1.454.CMB.2.raw
  modified_base (219)..(219): a, c, t, g, unknown or other
  modified_base (289)..(289): a, c, t, g, unknown or other
  modified_base (329)..(329): a, c, t, g, unknown or other
  modified_base (364)..(364): a, c, t, g, unknown or other
  modified_base (500)..(500): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgttactatccaaactggttccagcagaaacctggacaagcacccaggccactgatttanagtaacaaacaacagacactcctcggacccctgcccgttncagcctcctcgtcggggccaaagctcgccctgacncgtgcaggtgtgcacgccgtagacggacggagcgtagagtattacgcgtcctgtctacttagttagtgggtcgggtcgttgggtcggttcgggcgggaggaccgagcgtgaccgtcgtaggtcacgccgacggccnccgccccgtcggcctaccgtcgtccgtcccgccctccgtcgaccgcgcg

SEQ ID NO: 415695 - DNA, 573 bp, Homo sapiens
  misc_feature: GZ8MTXP02G8XAB.8.43.D10.1.454.CMB.2.raw
  modified_base (373)..(373): a, c, t, g, unknown or other
  modified_base (564)..(564): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctgacaagcacccaggccactgattatagtacaaacaacagacactcctggaccccctgccccggttctccacggcctcccctccgttcggggcccaaagctcgccctgacnctgtcaggtgtgcagccctgaggacgaggctgagtattactgcctgctctattagtggtgggtccgttgggtcggtttcggcgggtagggaccgaaggcgtggaccgtcgtacggtcacggcccaaacgggcctaccggcccccgtcggtccctaccgttcgtccgttccccgcccctaccgtccgaaccncggacccgg

SEQ ID NO: 415696 - DNA, 540 bp, Homo sapiens
  misc_feature: GZ8MTXP02G4Z5T.8.43.D10.1.454.CMB.2.raw
  modified_base (288)..(288): a, c, t, g, unknown or other
  modified_base (361)..(361): a, c, t, g, unknown or other
  modified_base (398)..(398): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcacccaggccactgattanagtacaaacaacagacactcctggacccctgcccggttctcaggctccctctcggggccaagctgccctgacnctgtcaggtgtgcagcctgagacgagctgagtatacngctgctctattagtggtggtcgttgggtggttcggcggacggtacaagtcgtcgaccgtcgtacggtacacgacccgaacggcctaccggcccccgtacggtcctacgtccgtcgtccccaccctccgtccgaccgacgccg

SEQ ID NO: 415697 - DNA, 560 bp, Homo sapiens
  misc_feature: GZ8MTXP02GXQY2.8.43.D10.1.454.CMB.2.raw
  modified_base (287)..(287): a, c, t, g, unknown or other
  modified_base (328)..(328): a, c, t, g, unknown or other
  modified_base (497)..(497): a, c, t, g, unknown or other
  modified_base (533)..(533): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaactggacaagcacccagccactgattanagtacaaacaacagacactcctcggacccctgcccggttcncgacgtcctccgtccgttcggggaccaaagctcgccctgacactgtacgaggtgtcgcgagccctgacggacgagcgtgagtattactgacctgctctattacgtggtggtcgttgggtggtcggcggacggacagcgtgaccgtcgtacggtcacggaccacggtccnccgtccccgtcggtcctacctccgtccgttaccccncccgtaccgtccgaccgaccggaccgg

SEQ ID NO: 415698 - DNA, 577 bp, Homo sapiens
  misc_feature: GZ8MTXP02JXRXA.8.43.D10.1.454.CMB.2.raw
  modified_base (290)..(290): a, c, t, g, unknown or other
  modified_base (365)..(365): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcagctccctccttcggggccaaagctgccctgacnctgcaggtgtgcagccctgaggacgaggctgagtattactgcctgctctattagtgggtcgggtccgtttggggtcggtttcgggcgggaggggtaccgaaggcgtcggacccgtccgtacggtcacggcccgaaacggccgtcgcccccgtccgggtcctaccgttccgtccggttccccgtccccttcccgtccgaccgtaccggcccgg

SEQ ID NO: 415699 - DNA, 564 bp, Homo sapiens
  misc_feature: GZ8MTXP02IU5JK.8.43.D10.1.454.CMB.2.raw
  modified_base (283)..(283): a, c, t, g, unknown or other
  modified_base (368)..(368): a, c, t, g, unknown or other
  modified_base (410)..(410): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttacatccaaatggtccagcagaacctggacaagcaccaggccactgattanagtacaaacaacagaacactcctcggacccctgcccggttctcacgtcctcccgtccgttcggggacccaaagcctgccctgacnctgtcaggtgtagcagccgtgaggacgagctagagtatacgngtctgctctattagtggtcggtcgttgggtgttcggacggacggacgaacgcgtacgtaccgtcgtacggtcacgacccgaacggtcctccgtacccccgtcggtacctccgttccgttcccggttcccctcccgtccctccggaccaccgccg

SEQ ID NO: 415700 - DNA, 549 bp, Homo sapiens
  misc_feature: GZ8MTXP02JHARE.8.43.D10.1.454.CMB.2.raw
  modified_base (378)..(378): a, c, t, g, unknown or other
  modified_base (388)..(388): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggaccccctgccccggttctcgacggcctccccgtccgttcggggcccaaagcctagcccctgacnctgtcaggtntgcagccctgaggacgaggctgagtatacgtgcctgctctattagtgggtgggtccgttgggtggttcggcgggaggtaccaagctgaccgtctaggtcacgccaaggcctacgccccctcggccacgtcgtccgttcccaccctcctccgaccacgtccg

SEQ ID NO: 415701 - DNA, 565 bp, Homo sapiens
  misc_feature: GZ8MTXP02G2VHV.8.43.D10.1.454.CMB.2.raw
  modified_base (287)..(287): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggtactatccaaactggtccagcagaaacctggacaagcacccaggccactgattanagtaacaaacaacagacactcctacggacccctgccccggttctcacggcctccctccgttcggggaccaaagctacgccctgacacgtgtcgaggtgtagcagccctagagacgagctgagtatactgctgctctattagtggtgggtcgttgggtggttcggacggtagggaccgaagcgtagacccgtcgtacggtcacgaccaaacggcctccgcccccgtcggtcctacctccgttccgttcccccacccctccctaccgacccacgacccgg

SEQ ID NO: 415702 - DNA, 552 bp, Homo sapiens
  misc_feature: GZ8MTXP02FSSZY.8.43.D10.1.454.CMB.2.raw
  modified_base (290)..(290): a, c, t, g, unknown or other
  modified_base (327)..(327): a, c, t, g, unknown or other
  modified_base (364)..(364): a, c, t, g, unknown or other
  modified_base (374)..(374): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacacagacactcctggacccctgcccgttntcaggctccctccttcggggaccaagctgccctgacnctgtcaggtntgcagcctgaggacgaggctgagtatactgcctgctctattagtggtgggtccgtttgggtggttcggcgggagggacaagcgtgaccgtctacggtcacggccctaacggtccgacccccgtcggtccaccttccgttccgttcccccgccctcccgtaccgaccgaccggccgacg

SEQ ID NO: 415703 - DNA, 555 bp, Homo sapiens
  misc_feature: GZ8MTXP02F55BS.8.43.D10.1.454.CMB.2.raw
  modified_base (290)..(290): a, c, t, g, unknown or other
  modified_base (409)..(409): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtctccaggagggacagtcactctcacctgtgcttccagcactggagcagtcaccagtggttactatccaaactggttccagcagaaacctggacaagcacccaggccactgatttanagtacaaacaacagacactcctcgacccctgcccggttctcaggcctccctcccgttggggccaaaagctgccctgacactgtcaggtgtgcagcctgaggacgaggctgagtattacngctagctctattatggtggtccgttggggtgttcgggcggtacgggaccaaggcgtacgaccgtcgtacggtccgaacggcccaaaggcgtccgcccccgtcggtccaaccgtcgtccgttccccgccctcctccgaccgtaccgg

SEQ ID NO: 415704 - DNA, 500 bp, Homo sapiens
  misc_feature: GZ8MTXP02I180J.8.43.D10.1.454.CMB.2.raw
  modified_base (217)..(217): a, c, t, g, unknown or other
  modified_base (250)..(250): a, c, t, g, unknown or other
  modified_base (264)..(265): a, c, t, g, unknown or other
  modified_base (270)..(270): a, c, t, g, unknown or other
  modified_base (272)..(272): a, c, t, g, unknown or other
  modified_base (274)..(274): a, c, t, g, unknown or other
  modified_base (277)..(277): a, c, t, g, unknown or other
  modified_base (279)..(279): a, c, t, g, unknown or other
  modified_base (281)..(281): a, c, t, g, unknown or other
  modified_base (286)..(286): a, c, t, g, unknown or other
  modified_base (288)..(288): a, c, t, g, unknown or other
  modified_base (293)..(293): a, c, t, g, unknown or other
  modified_base (300)..(300): a, c, t, g, unknown or other
  modified_base (345)..(345): a, c, t, g, unknown or other
tcagctcgcgtgtccacgaccggtgctcgatttagactagcagtaagggggccccaggggtcccttccaatatcagcaccatggcctggactcctctctttctgttcctcctcacttgctgcccagggtccaattctcagactgtggtgactcaggagccctcactgactgtcgtcccaggaggacagtcactctcacctgtgcttcagcactggancagtcacagtgtactatcaatgtcagcagaacngacagcaccagcannattanananaanananacacncngaccngcccgtncagcctcctcgtggacccaaagctagccctgacactgtcaggtgngcagcctagagacgagctagagtaatactgcctgctatagttagtggtggtcgttgggtcgttcgggacggaaggaccaagcgtagaccgttcaggcacgcccaaggcctcgccccgtcgaccactcgtcgtcccacctccacgacaccgcgacg

SEQ ID NO: 415705 - DNA, 542 bp, Homo sapiens
  misc_feature: GZ8MTXP02HEED1.8.43.D10.1.454.CMB.2.raw
  modified_base (259)..(259): a, c, t, g, unknown or other
  modified_base (282)..(282): a, c, t, g, unknown or other
  modified_base (318)..(318): a, c, t, g, unknown or other
  modified_base (351)..(351): a, c, t, g, unknown or other
  modified_base (378)..(378): a, c, t, g, unknown or other
  modified_base (392)..(392): a, c, t, g, unknown or other
  modified_base (400)..(400): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggtccagcagaaccnggacaagcaccagccatgattanagacaaacacagacactcctggacccctgcccgttntcagcctcctctcgggaccaagctgccctgacnctgtcaggtgagcagccgtagagacgngctgagttattacngcctgctntattagtggtcggtcgttgggtggttcggacgggtaggaccgaggtcgtggacccgtcgtacggtcacgcccgaacggtcctccgtcccccgtacgtcctacgttcctccgttcccccacccgtcctaccgaccgaccgtcg

SEQ ID NO: 415706 - DNA, 573 bp, Homo sapiens
  misc_feature: GZ8MTXP02JIL6J.8.43.D10.1.454.CMB.2.raw
  modified_base (290)..(290): a, c, t, g, unknown or other
  modified_base (477)..(477): a, c, t, g, unknown or other
  modified_base (553)..(553): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcagaaacctggacaagcaccaggccactgatttanagtacaaacaacagacactcctcggacccctggtcccggttctcacggcctccccgtccgttcggggacccaaagtcctacggcccctaggaaccacgtcgtccaggggttcgtgctagcccgtaggaggacgaggtctagagttatacgtcgctgctctatagtgggtggtcgttggtggttcggngggtaggacaggctagtaccgtcgtacggtcacggacccgaacgctcgccccgtcggcctactccgtcgttacccncccgtcctcgaccgacgtcg

SEQ ID NO: 415707 - DNA, 568 bp, Homo sapiens
  misc_feature: GZ8MTXP02GLGZP.8.43.D10.1.454.CMB.2.raw
  modified_base (290)..(290): a, c, t, g, unknown or other
  modified_base (330)..(330): a, c, t, g, unknown or other
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggacccctgcccggttntcacggctccctcgttcggggccaaagctcgccctgacnctgtcaggtgtgcagcctgaggacgagctgagtatactgcctgctctattagtgggtgggtccgttgggtcggttcgggcgggtacgggaccaaggcgtacggtaccgtcgtaggtcgacggcccgaacgggtcctccggcccccgtcggtcctaccgttccgttccgttccccgtccctcccgtccgaccacggccgg

SEQ ID NO: 415708 - DNA, 592 bp, Homo sapiens
  misc_feature: GZ8MTXP02GWUPL.8.43.D10.1.454.CMB.2.raw
  modified_base (324)..(324): a, c, t, g, unknown or other
  modified_base (372)..(372): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaactggacagcaccagccactgattatagtacaaacacagacactcctggacccctcgcccggttcncgacggtccctcccgtccgtccggggaccaaagtctcgcccctgaccncgtgtcgaggtgtgcagccctagaggacggaggcgtaggagtacttactcgtaccgtgtctacgtattagtgggtcggtcgttggggtcggttcggcgggtaggaccgaaggtcgtacggaccgtcgtacggtacgacgacccgtaacggcctaccggtccccccgtcggtcctaccgtccgttccggtccccctcccggtcctccggacctacggaccg

SEQ ID NO: 415709 - DNA, 526 bp, Homo sapiens
  misc_feature: GZ8MTXP02HKVVR.8.43.D10.1.454.CMB.2.raw
  modified_base (317)..(317): a, c, t, g, unknown or other
  modified_base (353)..(353): a, c, t, g, unknown or other
  modified_base (362)..(362): a, c, t, g, unknown or other
  modified_base (371)..(371): a, c, t, g, unknown or other
  modified_base (508)..(508): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaatgtccagcagaacctgacagcaccagccactgattatagtaacaaacaacagacactctcggacccctgcccgtntcacgcctcctcgtcgggaccaagctagccctgacnctgcaggtncgcagtccngagcgagcagtagtatactgcctgctactattagtggtcggtcgtgggtcggttacggcggagggaccaagtcgtgaccgtccgtaggtcacgtccgaacgcgttccgccccgtcggtcctacgtccgtcttccccncctccgccgaccacgccg

SEQ ID NO: 415710 - DNA, 562 bp, Homo sapiens
  misc_feature: GZ8MTXP02H5C7M.8.43.D10.1.454.CMB.2.raw
  modified_base (256)..(256): a, c, t, g, unknown or other
  modified_base (276)..(276): a, c, t, g, unknown or other
  modified_base (316)..(316): a, c, t, g, unknown or other
  modified_base (465)..(465): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttacataccaatgtcagcagaacanacagcaccagccatgattanagtaacaaacaacagaccactcctcgacccctgcccgttncgacgcctccctcgtcgggaccaacgctcgcctgacctcgtcgtcgaggtgtacgcgagcccgtagacggacggaggctagagttaaactcgtcgtcgtgtctactagtttagtcgggttcgggttccgttgggttcgggttacggggnggacgggacgtaagcgtacggacgtccgtaggcacggaccacggtcctaccgtcccgtcgtcaccgttctccgtacccacccgtctaccgcaccgcg

SEQ ID NO: 415711 - DNA, 551 bp, Homo sapiens
  misc_feature: GZ8MTXP02IEZLL.8.43.D10.1.454.CMB.2.raw
  modified_base (290)..(290): a, c, t, g, unknown or other
  modified_base (330)..(330): a, c, t, g, unknown or other
  modified_base (371)..(371): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctcggacccctgcccggttntcgacggcctaccctcgttcggggccaaagctgccctgacnctgtcagtgtgcagcctgagacgaggctagagtatactgacctgctctattagtggtggtccgttgggttcggtcgggtggacggacgaagcgtacgaccgtcgacggtcacgtccgaacgcctccgcccgtacggtcctacgtccgttcgtcccctaccctcctaccgaccacggaccg

SEQ ID NO: 415712 - DNA, 523 bp, Homo sapiens
  misc_feature: GZ8MTXP02H4VGW.8.43.D10.1.454.CMB.2.raw
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaactggttccagcagaaacctggacaagcacccaggccactgatttatagtacaaacaacagaacactcctggaccccctgcccggttctcaggcctccctccttcggggccaaagctcgccctgacncgtgtcaggtgtgcagcctgaggacgaggctgagttatactgctgctctattagtggtggtcgttgggtgttcggcggaggacgagcgtgaccgtcgtagtcagccacgctcgccccgtcgtccactcctcgtcccacctccgtccacgacgcg

SEQ ID NO: 415713 - DNA, 573 bp, Homo sapiens
  misc_feature: GZ8MTXP02FFX1O.8.43.D10.1.454.CMB.2.raw
  modified_base (285)..(285): a, c, t, g, unknown or other
  modified_base (299)..(299): a, c, t, g, unknown or other
  modified_base (325)..(325): a, c, t, g, unknown or other
  modified_base (367)..(367): a, c, t, g, unknown or other
  modified_base (375)..(375): a, c, t, g, unknown or other
  modified_base (379)..(379): a, c, t, g, unknown or other
tcagctcgcgtgtccacgaccggtgctcgatttagactagcagtaaggggcgccagggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttcagcactggagcagtcaccagtggttactatccaaactggtaccagcagaaacctggacaagcacccaggccactgattanagtaacaaacaacngacactcctgacccctgccccggttntcgacggctccccgtcgtccggggccaaagctcgccctgacnctgtacgngtgncgacgcgagaggacggagctagtagtactactcgtccgtgtccttacttagttagtgggtcggtcggttgggttcgggtacgggcgggacggaccgagcgtacggaccgtaccgtacgtaccgacgaccgtacgccgtcccgtccccgtccgtcctacctccgtccgtcccctaccctccgaccgaccgacgcg

SEQ ID NO: 415714 - DNA, 814 bp, Homo sapiens
  misc_feature: GZ8MTXP02H7DS0.8.43.D10.1.454.CMB.2.raw
  modified_base (284)..(284): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggtccagcagaacctggacaagcaccagccactgatttanagtaacaaacaacagacactcctacggaccccctgaccccggttctcgaacggtcctaccccgttccgttccggggacccaaaagtccgtccgtcccctaggaacctaccgtggttacccgaaggggtttcgtcgccgtaacgggtcccgtacgggaacggggtacggaaacggggtccgttaaggaacgtttaacgtttaaccgtacggtacccccgttgggtccctttaccgttaaagttttacgggttagggggtttcgggggttcccggttttggggggttacggttttcccggggggacggggttaaaccgggggtaccccgaaaacgggtccggtttaacccggggtaacccggtttacccggttaaccggggttacctaaacccggggtacccccggaaaacgggtaccccgttccccgggtacccccccggttcgggttaccccaacccggtttcccgttccccggtttacccccctaaccccgtttccccgtacccggtaaaccctacccgggaacccggg

SEQ ID NO: 415715 - DNA, 520 bp, Homo sapiens
  misc_feature: GZ8MTXP02JH7TI.8.43.D10.1.454.CMB.2.raw
  modified_base (286)..(286): a, c, t, g, unknown or other
  modified_base (401)..(401): a, c, t, g, unknown or other
  modified_base (507)..(507): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaacctggacaagcaccagccactgatttanagtacaaacaacagacactctcggacccctgcccggttctcagcctccctccgtcggggccaaagctcgccctgactctgtcaggtgtgcagcctgaggacgagctgagtatacngcctgctctatgtggtgggtcgttgggtgttcggcggaggaccagctgaccgtcgagtcagcccaaggcctcgccccgtcgtccactccgtcttcccacccttccnccgaccgacgccg

SEQ ID NO: 415716 - DNA, 540 bp, Homo sapiens
  misc_feature: GZ8MTXP02IIJ35.8.43.D10.1.454.CMB.2.raw
  modified_base (289)..(289): a, c, t, g, unknown or other
  modified_base (330)..(330): a, c, t, g, unknown or other
  modified_base (373)..(373): a, c, t, g, unknown or other
  modified_base (494)..(494): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctcggacccctgcccggttcncacggcctccctccgttggggaccaaacgctcgcccctgaccncgtgtcaggttgtgcagcctgaggacgaggctagagtattactgctgctctattagtggtgggtccttgggtgttcgggcggtacggacaagcgtgaccgtcgtaggtcagcccaaggccncgtccccgtcggtcactcgtcgttccccacctcctcgaccacgccg

SEQ ID NO: 415717 - DNA, 620 bp, Homo sapiens
  misc_feature: GZ8MTXP02G121E.8.43.D10.1.454.CMB.2.raw
  modified_base (278)..(278): a, c, t, g, unknown or other
  modified_base (300)..(300): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgtacatccaaatggtcagcagaacctgacaagcaccagccactgattanagtaacaaacaacagacactcncgacccctgcccggtctcaggcctccctcgtcggggaccaaagctcggccctgactactgtacgagggttgngcacgccgtagacgggaccggaggtcgtaggaagttaattaccgtcgtcccgtcgtccttacttaatttaggtggggttcgggttcccggttgggggttcgggttaccggggacgggaaggggaacccaaaggtccgtacggtacccgtccgttaacggtccgacgaccccggaaaggtccctccggcccccgttcggtacccacctccgttccgtacccccaccctcccgtaccggaccacgaccgg

SEQ ID NO: 415718 - DNA, 571 bp, Homo sapiens
  misc_feature: GZ8MTXP02HNGW1.8.43.D10.1.454.CMB.2.raw
  modified_base (289)..(289): a, c, t, g, unknown or other
tcagctcgcgtgtccacgaccggtgctcgatttagactagcagtaagggggcgccaggggtcccttccaatatcaccaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtacaaacaacagacactcctggacccctgcccggtctcaggctccctcttgggccccaaagctgccctgacactgcaggtgtgctagcctggaggacgaggctggagttattactgccgtgcttctattagtggtgggtccgttcggggttggttcgggcgggacgggaccgaaggtcgtcggacccgttccgtaggtccacggcccgaaaggcccgtcggcccccgtcggtcctaccgtccgtccgttccccgcccgtcccgtccgaccaccgcgacgg

SEQ ID NO: 415719 - DNA, 576 bp, Homo sapiens
  misc_feature: GZ8MTXP02IQ889.8.43.D10.1.454.CMB.2.raw
  modified_base (289)..(289): a, c, t, g, unknown or other
  modified_base (373)..(373): a, c, t, g, unknown or other
  modified_base (386)..(386): a, c, t, g, unknown or other
  modified_base (569)..(569): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtgttactatccaaactggttccagcagaaacctggacaagcacccaggccactgattanagtaacaaacaacagacactcctacggaccccctgcccggttctcgacgcctccctcgttcggggacccaagctcgccctgacncgtgtccgaggtntgcagccctgaggacgaggctggaagttattactgccctgcttacttagttagtgggtcgggttcgttgggtggttcgggacggagggaccagcgtcggaaccgtctaggtcacgaccgaacggtcctccggcccccgtcggtcctaccgtccgtcccgttccccgtcccctccgtccgaccncggaccg

SEQ ID NO: 415720 - DNA, 664 bp, Homo sapiens
  misc_feature: GZ8MTXP02IBHQ7.8.43.D10.1.454.CMB.2.raw
  modified_base (337)..(337): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactataccaaactggtccagcagaaacctggaacaagccacccaggccactgtattatagtaacaaacaacagaccactcctacggacccctgtcccggttcncgacggtcctcccgtcgtccgggaccaaagcctcgccctgacctactcgtcgaggtgtcgcgacgcccgtaggacggacggaggtcgtaggtagttattacgtcgtccgtcgtctacgttagtttaggttcgggttcggggttcggtttggggttcgggttacggggtcggggtaacgggaccgtaaacggtccggttaacggtacccggttaccgtacgggttaccgacggacccgaaacggtccgtacccggccccccgttcgggttacccaccgttccgttcccgttcccccgtcccgttcccgtcccggaccgaccggcccgg

SEQ ID NO: 415721 - DNA, 579 bp, Homo sapiens
  misc_feature: GZ8MTXP02FIAR1.8.43.D10.1.454.CMB.2.raw
  modified_base (290)..(290): a, c, t, g, unknown or other
  modified_base (364)..(364): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttctcaggctccctctcggggccaaagctgccctgacnctgtcaggtcgtgcagcctgaggacgaggctgagtatactgcctgctctattagtgggtgggtccgttggggtcggtttcgggccgggaggggaccgaaagcgtaggacccgttccgtacggttacacggacccgaaacgggcctccggccccccgttcgggtccaaccggttcctcggttacccccaccccttcccgtaccgaccaccggccgg

SEQ ID NO: 415722 - DNA, 784 bp, Homo sapiens
  misc_feature: GZ8MTXP02GZXMU.8.43.D10.1.454.CMB.2.raw
  modified_base (288)..(288): a, c, t, g, unknown or other
  modified_base (300)..(300): a, c, t, g, unknown or other
  modified_base (309)..(309): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctggacaagcacccaggccactgattanagtacaaacaanagacactcncggacccctgtcccgttctcacgcctccctctacggggccaaagctcgcccctgaccacgtgtacgaggttgtgcacggcccgttagggaacgggacggacgggtccgtaggtaacgttaacgtttacccgtcggtaccccgttgggtacccttaccgtttaaacggtttaagtttacgggggttcccgggggtttacccgggttttggggggtttaccgggtttcccgggggaacccgggggtaacgggggttaacccccgaaaaggggttccccggttaacgggtaacccccggttttaccgtaaaccggggtttacccgaaaaccgggtacccccgtaaaacgggggtacccccgttacccgggtaccccccccggttccgggttacccgtaacccgtttcccgttcccccgggttttaccccccgcccccgtttaacccgtccccggaaccccgttaaccggaccccgggg

SEQ ID NO: 415723 - DNA, 589 bp, Homo sapiens
  misc_feature: GZ8MTXP02G7ABL.8.43.D10.1.454.CMB.2.raw
  modified_base (285)..(285): a, c, t, g, unknown or other
  modified_base (367)..(367): a, c, t, g, unknown or other
  modified_base (410)..(410): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaacctgacaagcaccaggccactgattanagtacaaacaacagacactcctagacccctgcccggttactcgacggcctcccgtcgttcgggccaaacgctcgccctgacnctgtcaggtcgtgcagccctagagacgagcgtgagttattacncgtacgtgtctcgttagttacgtgggtcgggtccgttgggtggttcggcgggacggtaccgaagcgtacggaccgtccgtacggtccgacgcccgtaaacggcctcggcccccgttcgggtacctaccgttccgtccggttacccctacccctacccgttacccgaccgaacgcccggg

SEQ ID NO: 415724 - DNA, 579 bp, Homo sapiens
  misc_feature: GZ8MTXP02FHZUX.8.43.D10.1.454.CMB.2.raw
  modified_base (288)..(288): a, c, t, g, unknown or other
  modified_base (369)..(369): a, c, t, g, unknown or other
  modified_base (379)..(379): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggttccagcagaaacctggacaagcaccaggccactgatttanagtaacaaacaacagacactcctggacccctgcccggttctcacggcctccctcgttcggggaccaaagctcgccctgacnctgtcaggtntgcagcctgaggacgaggctagagttatactgccgtgtctctattagtgggtcgggtcgttgggtcggttcggcgggtagggaccgaagtcgtacgtaccgtcgtacggtcgacggcccgaaacggtccgttccggaccccccgttcggtccacccgttccgtccgttacccccaccctcccgtaccgacccgacggccg

SEQ ID NO: 415725 - DNA, 658 bp, Homo sapiens
  misc_feature: GZ8MTXP02H0YOU.8.43.D10.1.454.CMB.2.raw
  modified_base (260)..(260): a, c, t, g, unknown or other
  modified_base (280)..(280): a, c, t, g, unknown or other
  modified_base (319)..(319): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggagcagtcacagtgttactataccaaactgtcagcagaacngacagcaccagcatgattanagtaacaaacaacagacactcctcgacccctgcccgttncgacgtcctcctcgtcgggaccaaagctcgcctagacctcgtcgtcgagggttcgtcgcgacggtccgtaggacggacggacggtcgtaggtaagttacttacgtcgtaccgtgtcttacgttagtttaggttgggttcggggttccggtttgggggtttcgggttaccggggcgggaacgggtaaccgtaacggtcgtaccgggtaccgttaccgtaacgggtccgaccggacccggaaacggtcccgtacccggtcccccgtaccggttacccgtaccgttcccgttacccgttaccccctacccccgttacccgtacccgtaacccgaccggcccg

SEQ ID NO: 415726 - DNA, 572 bp, Homo sapiens
  misc_feature: GZ8MTXP02IWW1G.8.43.D10.1.454.CMB.2.raw
  modified_base (253)..(253): a, c, t, g, unknown or other
  modified_base (277)..(277): a, c, t, g, unknown or other
  modified_base (370)..(370): a, c, t, g, unknown or other
  modified_base (418)..(418): a, c, t, g, unknown or other
  modified_base (459)..(459): a, c, t, g, unknown or other
  modified_base (525)..(525): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgtacatccaatgtccagcagaacngacaagcaccagccactgatttanagtaacaaacaacagaaccactcctcggaccccctgtccccggttctcgacgtcctcccctccgttcggggacccaaagcctcgccctagacncgtgtacaggtgtgactagccctgaggtacgagggctagagtattacngcctgctactattacgtggtcggtcgttgggtcggttcggnggacggtacagcgtcgacgtcgtacggtacacggtacccaacggcctccgtcccccgtcggtaccnccgttccgttccgtccccgtcccgttcccgaccgtaccgaccgtcgg

SEQ ID NO: 415727 - DNA, 572 bp, Homo sapiens
  misc_feature: GZ8MTXP02HDDGM.8.43.D10.1.454.CMB.2.raw
  modified_base (287)..(287): a, c, t, g, unknown or other
  modified_base (415)..(415): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagccactctcacctgtgcttccagcactggagcagtcaccagtgttactatccaaactggttccagcagaaacctgacaagcaccaggccactgatttanagtacaaacaacagacactcctcggacccctgcccggttctcctggcctccccgtcgttcggggaccaaagctcgccctgaccacgtcgtcagggtgtgcacgcctgaggacgaggctgagtatacgngcctgctcttattagtggtcggtcgttgggtggttcggcggtagggaccgtaagcgtacgtaccgtcgtacggtccgacgcccgaaacggcctccggcccccgtcggtccctaccgtccgttccgttccccgtccctaccgtccggaaccgcgaccg

SEQ ID NO: 415728 - DNA, 524 bp, Homo sapiens
  misc_feature: GZ8MTXP02JNAKD.8.43.D10.1.454.CMB.2.raw
  modified_base (290)..(290): a, c, t, g, unknown or other
  modified_base (329)..(329): a, c, t, g, unknown or other
  modified_base (363)..(363): a, c, t, g, unknown or other
  modified_base (373)..(373): a, c, t, g, unknown or other
  modified_base (404)..(404): a, c, t, g, unknown or other
  modified_base (495)..(495): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctggacccctgcccggttncaggctccctctcggggccaaagctgccctgacnctgtcaggtntgcagcctgaggacgaggctgagtattaccngcctgctctattatgggtggtccttgggtgttcggcggtaggaccaagcgtcgaccgtcaaggtcagcccgaaggctcgccccgtcggtcncgtctcgttccccacctcctcgacacgcg

SEQ ID NO: 415729 - DNA, 720 bp, Homo sapiens
  misc_feature: GZ8MTXP02G7TXV.8.43.D10.1.454.CMB.2.raw
  modified_base (287)..(287): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtcagcagaaacctggacaagcaccaggccactgatttanagtacaaacaacagacactcctcggacccctgcccggttctcacggcctcccgtcgttccggggaccaaagctcgccctagactacgtgtcagggtgtcgcacgccgtagacggacgaggcgtaggtaacgttagttaccgtcgtaccgtcggtacttaccgttaaagtttaggttcgggggttcgggggttcccggttttggggggtttcgggtttaccgggggtacccgggggtaacgggggtaacccggtaaacgggtccggttaccgggaccccgggtttacccgtaacggggttacccgaaccgggttaccccggaaacggggtcccgttacccgggtcccccccgttacgggggtacccctacccggttcccgttcccggtttacccccaccccgttccccgtaccggtacccggccggtacccggg

SEQ ID NO: 415730 - DNA, 706 bp, Homo sapiens
  misc_feature: GZ8MTXP02JPFE2.8.43.D10.1.454.CMB.2.raw
  modified_base (288)..(288): a, c, t, g, unknown or other
  modified_base (329)..(329): a, c, t, g, unknown or other
  modified_base (364)..(364): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaacctggacaagcacccagccactgattanagtaacaaacaacagacactccgtcgacccctgcccgttcncacgcctcccctcgtcggggaccaagctcgccctnacacgtgtacagggtgtcgcacgccgtagacggacggaggcgtaggtaagttacttaccgtcgtccctggtaccttacttagtttacggtgggttcgggggttccccgtttgggggttcggggtttaccgggggacggggtaaccgggggtaaacccgtaacgggtaccgttaccgggtaccccgttacccggtaacgggttacccgaaccgggaaccccgtaaaccggggtccctacccggtcccccccgttccgggtacccctaacccgttccggttacccccgtttacccccccgtaaccccctccccgttacccggaaacccgtcccggtaacccggg

SEQ ID NO: 415731 - DNA, 547 bp, Homo sapiens
  misc_feature: GZ8MTXP02HLMQU.8.43.D10.1.454.CMB.2.raw
  modified_base (373)..(373): a, c, t, g, unknown or other
  modified_base (412)..(412): a, c, t, g, unknown or other
  modified_base (530)..(530): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggaccccctgcccggttctcacggcctccctccgttcggggcccaaagctcgccctgacnctgtcaggtgtgcagcctgaggacgagctgagtattacngctgctctattagtggtgggtcgttgggtcggttcgggcggagggtaccgaaggtcgtcgaccgtcgtaggtcacgccgaacggcctccgccccgtcggtccacctccgtcgttcccncctccgtccgacacgcg

SEQ ID NO: 415732 - DNA, 560 bp, Homo sapiens
  misc_feature: GZ8MTXP02GQJE7.8.43.D10.1.454.CMB.2.raw
  modified_base (287)..(287): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaacctggacaagcacccaggccactgatttanagtacaaacaacagacactcctggaccccctgcccggttctcaggcctcccgtccttcggggcccaaagctcgccctgacncgtgtcaggtgtgcagcccgtgaggacgaggctgagtatactgcctgctctattagtggtgggtcgttggggtgttcgggcggaggtaccgaagcgtcgaccgtcgtaggtcacggccgaacggcctccggcccccgttacggtcctacgtcctccggttaccccacccgttcccgaccgtaccgacgccgg

SEQ ID NO: 415733 - DNA, 555 bp, Homo sapiens
  misc_feature: GZ8MTXP02FI6VW.8.43.D10.1.454.CMB.2.raw
  modified_base (291)..(291): a, c, t, g, unknown or other
  modified_base (370)..(370): a, c, t, g, unknown or other
  modified_base (372)..(372): a, c, t, g, unknown or other
  modified_base (549)..(549): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggaccccctgccccggttctcaggctccctccttggggccaaagctgcccctgacncngtcaggtgtgcagccctgaggacgaggctgagtatactgcctgctctattatggtgggtccttggggtggttcgggcgggtaggggaccgaaggcctacggaccgtccgtaggtccgacggccccgaaacggctccgccccctcggtccactcgtcgttccccacccgtcctcgacncgaacg

SEQ ID NO: 415734 - DNA, 551 bp, Homo sapiens
  misc_feature: GZ8MTXP02F8W79.8.43.D10.1.454.CMB.2.raw
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgccccggttctcaggcctccctccttggggcccaaagctcgccctgacnctgtcaggtgtgcagcctgaggacgaggctgagtatactgcctgctctattatgggtgggtccgtttggggtgttcgggcggtacggggaccaaaggtctggaccgtctacggtcacgcccgaaacggcctcgcccccgtcggctaccgtcctcgttccccacccgtcctaccgacacgcgg

SEQ ID NO: 415735 - DNA, 613 bp, Homo sapiens
  misc_feature: GZ8MTXP02IJKNF.8.43.D10.1.454.CMB.2.raw
  modified_base (331)..(331): a, c, t, g, unknown or other
  modified_base (376)..(376): a, c, t, g, unknown or other
  modified_base (406)..(406): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagccctcactgactgtgtccccaggaggacagtcactctcacctgtgcttccagcactggagcagtcaccagtgttactataccaaactgttccagcagaaacctggaacaagccacccaggccactgattatagtaacaaacaacagacactcctacgacccctgcccgttcncacgtcctccctccgttccggggaccaaagcctcgccctagaccnctgtcgaggtgtgcacgcctagacggacgnggctagagttattactgcctgctcttattagtggtcggtcgttgggttcggttacggcggacggaccgtaaggtcgtaccggaccgtaccgtacgggtaccacggaccccggtaaacggccgtcccgtacccccgtccggtaccgtacccgttcccgttcccgttcccccgtccccgttcccgttacccgacccgaaccggtcccgg

SEQ ID NO: 415736 - DNA, 550 bp, Homo sapiens
  misc_feature: GZ8MTXP02HAL1S.8.43.D10.1.454.CMB.2.raw
  modified_base (261)..(261): a, c, t, g, unknown or other
  modified_base (266)..(266): a, c, t, g, unknown or other
  modified_base (270)..(270): a, c, t, g, unknown or other
  modified_base (274)..(274): a, c, t, g, unknown or other
  modified_base (279)..(279): a, c, t, g, unknown or other
  modified_base (281)..(281): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
  modified_base (314)..(314): a, c, t, g, unknown or other
  modified_base (316)..(316): a, c, t, g, unknown or other
  modified_base (336)..(336): a, c, t, g, unknown or other
  modified_base (343)..(343): a, c, t, g, unknown or other
  modified_base (347)..(347): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatcaaactggtccagcagaaaccngacancacngcantatananacaaanananacactcgtacgacctcgccgtcncngtcctcctcgtccggacaanctcgccngacnctcgtacgaggtgcgcacgcgtagacgacggacgtcgtagtaagtacttacgtcgtctcgtcttacttagttaggtgggtcgggttcggttgggtcggtcggggacggacggacgagcgtacgaccgtcgtacgtccgacgaccgacgtccgtccgtcccgtcgtctacgttccgtccgtccccgcctccgaccgacgacgcg

SEQ ID NO: 415737 - DNA, 649 bp, Homo sapiens
  misc_feature: GZ8MTXP02GZV9K.8.43.D10.1.454.CMB.2.raw
  modified_base (288)..(288): a, c, t, g, unknown or other
  modified_base (322)..(322): a, c, t, g, unknown or other
  modified_base (361)..(361): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcaagaacctggacaagcaccagccactgattanagtaacaaacacagacactctcgaccctgccgtntcacgctccctcgtcgggaccaaagctacgccctagacnctcgtcaggtgtgcgagcccgtagacggacgacggcgtaggtaacgttatttaccgtcgtaccgtcggtaccttaccgttaaagttttaacggtggggttacggggttcccggtttgggggtttacgggtttccggggaccgggacgggtaccgaacggtccgtacggtacccgtacgtacggtccgaacggacccggtaaacggcccgtaccggtcccccgtacgggtacctaccgttcccgtccggttccccctccccgtcccgtacccggaccgtacgtacccgg

SEQ ID NO: 415738 - DNA, 562 bp, Homo sapiens
  misc_feature: GZ8MTXP02J0EJ3.8.43.D10.1.454.CMB.2.raw
  modified_base (370)..(370): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttatagtacaaacaacagacactcctggaccccctgcccggttctcaggcctcccctccgttcggggccaaagctcgccctgacnctgtcaggtgtgcagccgtgaggacgaggctgagtatactgcctgctctattagtgggtgggtccgttggggtcggtttcgggcggacggggacccgaaggtcgtcggtacccgtccgtaggtccgacgcccgaacgggcctcggccctccgtcggtcaacgtcctcgttccccaccctcctccgacaccgg

SEQ ID NO: 415739 - DNA, 550 bp, Homo sapiens
  misc_feature: GZ8MTXP02IRFM4.8.43.D10.1.454.CMB.2.raw
  modified_base (286)..(286): a, c, t, g, unknown or other
  modified_base (307)..(307): a, c, t, g, unknown or other
  modified_base (323)..(323): a, c, t, g, unknown or other
  modified_base (365)..(365): a, c, t, g, unknown or other
  modified_base (393)..(393): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactacccaactggttccagcagaaacctggacagcaccaggccactgattanagtacaaacacagacactccngacccctgcccgttcncagctcctctgggccccaagctgccctgacactgtcaggtgngcagcctgagacgaggctgagtattacngctgctctatagtggtcggtccgttgggtgttcgggcggtacgggaccaagcgtaggacccgttcgtaggtcacggcccgaaggccgtccgcccccgttcggtcccaaccgttccgtccgttcccccgacccgttccctacgaccgaccgccgaacg

SEQ ID NO: 415740 - DNA, 607 bp, Homo sapiens
  misc_feature: GZ8MTXP02JOX5G.8.43.D10.1.454.CMB.2.raw
  modified_base (219)..(219): a, c, t, g, unknown or other
  modified_base (262)..(262): a, c, t, g, unknown or other
  modified_base (283)..(283): a, c, t, g, unknown or other
  modified_base (298)..(298): a, c, t, g, unknown or other
  modified_base (321)..(321): a, c, t, g, unknown or other
  modified_base (350)..(350): a, c, t, g, unknown or other
  modified_base (354)..(354): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggtccagcagaacctnacagcaccagccactgattanagtaacaaacaacanacactcctcgaccctgcccgttncagcctcctcgtcgggaccaagctcgccngacnctgtcagggtgcgtcacgcccgtaggacgggaacggacggtcgtaggtaacgttacgttaacgtcgtccgttcgtacttacttaagttgttcgggttcggggtccgtttggggtcggttacgggcgggtacgggacgagtcgtcggtacccgtacgtacggtacgacggacccctaacggccgtacccggtcccccgttcggtccaccgtccgtcccgttccccctacccgtccctaccgacccgtacgccgg

SEQ ID NO: 415741 - DNA, 569 bp, Homo sapiens
  misc_feature: GZ8MTXP02HGN4A.8.43.D10.1.454.CMB.2.raw
  modified_base (276)..(276): a, c, t, g, unknown or other
  modified_base (285)..(285): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccagcactggagcagtcacagtgttacatcaaactgtcagcagaactgacaagcaccagccactgattanagtacaaanaacagacactcctcgacccctgtcccgtctcacgtcctcccgtccgtcggggaccaaacgcctcgccctgaccactcgtcgtaggtgtcgacacgcccgtgaggacggtagcgtagagttacttacgtcgtctgtcttactagttagtgggttcgggttcgttgggttcggttacgggcggtacgggaccgaagcgtacgaccgtcgtacggtcgacgtccgaacgcctcccgcccgtcggtcctacgtccgtccgtcccgtccctccgtccgaccgtcgaccg

SEQ ID NO: 415742 - DNA, 549 bp, Homo sapiens
  misc_feature: GZ8MTXP02IJ3ZG.8.43.D10.1.454.CMB.2.raw
  modified_base (373)..(373): a, c, t, g, unknown or other
  modified_base (384)..(384): a, c, t, g, unknown or other
  modified_base (421)..(421): a, c, t, g, unknown or other
  modified_base (451)..(451): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtgttactatccaaactgtccagcagaaacctgacaagcacccaggccactgatttatagtacaaacaacagaacactcctggaccccctgcccggttctcacggtcctccctccgttcggggcccaaaagctcgccctcgacnctgtcaggtgngcacgcctgaggcgagctagagtattactgcctgctntattagtggtacggtcttgggtgttcgggnggaggacaagcgtagaccgtcgtaggtcacgacccgaaggcctaccggccccctacggtcaccgttcgtccgtccctaccctcctccgaccacgtacg

SEQ ID NO: 415743 - DNA, 532 bp, Homo sapiens
  misc_feature: GZ8MTXP02FJ8QI.8.43.D10.1.454.CMB.2.raw
  modified_base (262)..(262): a, c, t, g, unknown or other
  modified_base (285)..(285): a, c, t, g, unknown or other
  modified_base (294)..(294): a, c, t, g, unknown or other
  modified_base (323)..(323): a, c, t, g, unknown or other
  modified_base (345)..(345): a, c, t, g, unknown or other
  modified_base (354)..(354): a, c, t, g, unknown or other
  modified_base (522)..(522): a, c, t, g, unknown or other
  modified_base (527)..(527): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtcagcagaaaccnggacaagcaccagccatgattanagtacaaanaacagacactccgtgacccctgcccgttncagctcctcgtcgggccaagcngccctgacnctgtcaggtgtgctagcctgaggacgaggctagtagtatactcgcctgctcttattagtggttgggtccgttggggtcgttcgggcggtaacgggaccaagcgtacgaccgtccgtaggtcagcccgaaggcctacgccccgtcgcctactcgtcgtacccacctccncgacncgacg

SEQ ID NO: 415744 - DNA, 658 bp, Homo sapiens
  misc_feature: GZ8MTXP02HM1AM.8.43.D10.1.454.CMB.2.raw
  modified_base (280)..(280): a, c, t, g, unknown or other
  modified_base (321)..(321): a, c, t, g, unknown or other
  modified_base (359)..(359): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactggagcagtcacagtgttactataccaaactggtccagcagaactgacagcaccagccatgattanagtaacaaacaacagacactcctcggacccctgtcccgtcncgacgtcctcccgtcgtcgggaccaagctcgcctgacncgtgtcaggtgtcgcgacgtcccgtaggacggtacggaggactaggtaagttacgttacgtcgtcctcggtccttacgttagttacggttggggttcggggtttccggttgggggttcgggttaccggggtacggggaacggggtaccgtaacggtcggtaccggtacccggttaccgtaacgggtaccgaccggacccggtaaacgggtcccgtacccgtcccccggttcgttacccgtaccgttcccgttacccgttcccccgtccccgttacccgtaccgtacccgaccggcccgg

SEQ ID NO: 415745 - DNA, 652 bp, Homo sapiens
  misc_feature: GZ8MTXP02JW3WM.8.43.D10.1.454.CMB.2.raw
  modified_base (285)..(285): a, c, t, g, unknown or other
  modified_base (324)..(324): a, c, t, g, unknown or other
  modified_base (351)..(351): a, c, t, g, unknown or other
  modified_base (360)..(360): a, c, t, g, unknown or other
tcagctcgcgtgtccacgaccggtgctcgatttagactagcagtaagggggcgccagggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtcagcagaactggacaagcaccaggccactgatttanaagtacaaacacagacactcctcggacccctgcccgttncacgcctccctcgtcgggaccaagtcncgcctgacncgtgtactaggtgtcgacacgccgtggaacggacgaggctaggaagttacttacgtcgtaccctgtccttacgttaagttacgttggggttcgggttccggtttggggttccggggtttcggggacggggtaacgggtaacccgtaaacgggtccgttaaccgggtacccgtaccgtacggggttacccgaaaccggcccgtaaacggtccgtacccggtcccccggtacgtccgtacccgtccgtttcccgtttaccccgtacccttacccgaccgtaccgacggtaccgg

SEQ ID NO: 415746 - DNA, 554 bp, Homo sapiens
  misc_feature: GZ8MTXP02HVYRM.8.43.D10.1.454.CMB.2.raw
  modified_base (163)..(163): a, c, t, g, unknown or other
  modified_base (288)..(288): a, c, t, g, unknown or other
  modified_base (380)..(380): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggagcagtcaccagtggttactatccaaactggttccagcagaaacctggacaagcaccaggccactgattanagtacaaacaacagaacactctggacccctgccgttctcagcctcctcttcgggaccaaagctcgcctgacactgtcaggtgtgcagtccgngagacgagctagagtatactgctgctctattgtggtcggtcgttgggtggtcggacggacggacgaacgtcgtacggtaccgtacgtacggtacgacgaccgtaacggccgtccgtccccgtaccggtcctacgtccgtcgttaccccgtaccctaccgtaccgtaccgacgcg

SEQ ID NO: 415747 - DNA, 851 bp, Homo sapiens
  misc_feature: GZ8MTXP02GE9CH.8.43.D10.1.454.CMB.2.raw
  modified_base (219)..(219): a, c, t, g, unknown or other
  modified_base (262)..(262): a, c, t, g, unknown or other
  modified_base (287)..(287): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgcgtccccaggagggacagtcactctcacctgtgcttccagcactggancagtcaccagtggtactataccaaactggtccagcagaaaccnggacaagcacccagccactgattanagtaacaaacaacagacactcctggacccctgccccggttctcacggcctccctccgttcggggacccaaaaggcctcggcccctaggaacctacgtcgtacgaaggggttgtcggaccaacggccccgttagggaaacggggaaccgggtaaacggggacccgttaagggtaaaccgggttttaaacttaaacccgtttacggggtaccccctttgggtaccccctttacgtttaaaacggttttaacggtttagggggtttacccggggggttacccggtttttagggggggtttaccgggggttttcccggggggtaacccgggggtaacggggggaaaacccccgtaaaacggggttcccggttacccggggtaaaacccccgggtttcccggttaaccgggggtttaccgaaacccgggtaacccccggaaaacggggtccccgttaccccgggtccccccccgtttaaccggggtccccttaaacccgttcccgtttaccccggtttcccccctaaccccccggtcccttacccggaaccccgtaaccggaccccggg

SEQ ID NO: 415748 - DNA, 526 bp, Homo sapiens
  misc_feature: GZ8MTXP02G6GIK.8.43.D10.1.454.CMB.2.raw
  modified_base (290)..(290): a, c, t, g, unknown or other
  modified_base (365)..(365): a, c, t, g, unknown or other
  modified_base (408)..(408): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattanagtacaaacaacagacactcctgacccctgcccggttctcagcctccctctcggggaccaaagctagccctgacnctgtacgaggtgtgcgagccctgaggacgaggctgagtatacngcctgctctatagtggtggtcgttgggtgttcggcggaggacgaagcgtgaccgtcgtaggtcacgccaacggctcgccccgtcggccactcgtcgtcccacctcctccgacacgacg

SEQ ID NO: 415749 - DNA, 555 bp, Homo sapiens
  misc_feature: GZ8MTXP02HGYNM.8.43.D10.1.454.CMB.2.raw
  modified_base (291)..(291): a, c, t, g, unknown or other
  modified_base (331)..(331): a, c, t, g, unknown or other
  modified_base (367)..(367): a, c, t, g, unknown or other
  modified_base (406)..(406): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtaacaaacaacagacactcctggacccctgcccggttncaggcctccctctcggggccaaagctcgccctgacnctgtcaggtgtgcagcctgaggacgagctgagtattacngcctgctctattacgtgggtcgggtccgttggggtcgttcgggcggtacgggaccaaggctggaccgtcgtaggtcacggcccaaggcctccgcccccgtcggtcctacctccgtccgttccccaccctccgtaccgaccgaccgccgg

SEQ ID NO: 415750 - DNA, 619 bp, Homo sapiens
  misc_feature: GZ8MTXP02JBR38.8.43.D10.1.454.CMB.2.raw
  modified_base (284)..(284): a, c, t, g, unknown or other
  modified_base (293)..(293): a, c, t, g, unknown or other
  modified_base (321)..(321): a, c, t, g, unknown or other
  modified_base (599)..(599): a, c, t, g, unknown or other
tcagctcgcgtgtccacgaccggtgctcgatttagactagcagtaaggggggcgccaggggtccctcccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaactggacaagcaccagccatgattanagtacaaanaacagacactctagacccctgcccgttncgagcctccctcgttcggggacccaaagctcgccctgacctcgtgtccaggtcgtacgcacggtcccagacggaccgaggctagagtattaccgtgtcccgtgactcttaagttacgttgggtcggggttccgtttgggggtacggtttccgggacgggaacggtaccggaaacgtcggttacgacccggtacgtacggttccgacggtacccgaacggccgttccgtacccccgtcggtaccctaccgttccgtcccggtttccccgcccgtttccncccggtacgacccggtccgg

SEQ ID NO: 415751 - DNA, 584 bp, Homo sapiens
  misc_feature: GZ8MTXP02JTFP5.8.43.D10.1.454.CMB.2.raw
  modified_base (164)..(164): a, c, t, g, unknown or other
  modified_base (221)..(221): a, c, t, g, unknown or other
  modified_base (285)..(285): a, c, t, g, unknown or other
  modified_base (308)..(308): a, c, t, g, unknown or other
  modified_base (325)..(325): a, c, t, g, unknown or other
  modified_base (359)..(359): a, c, t, g, unknown or other
  modified_base (364)..(364): a, c, t, g, unknown or other
  modified_base (369)..(369): a, c, t, g, unknown or other
  modified_base (409)..(409): a, c, t, g, unknown or other
tcagctcgcgtgtccacgaccggtgctcgatttagactagcagtaagggggcgccaggggtcccttccaatatcagcaccatggccctggactcctctctttctgttcctcctcacttgctgcccagggtccaattctcagactgtggtgactcaggagccctnactgactgtgtccccaggagggacagtcactctcaccgtgtgcttccagcactggancagtcaccagtgtacatccaaatggtccagcagaacctggacaagcaccaggccactgatttanagtaacaaacaacagacactccncggacccctgcccgttncagcctcctcgtcggggccaaagctcgcctgacnctgtnaggtntagcacgtcctaggacgacgaggcgtagtaagtacttacngtcccgtgtctcttaaagttgttgggtcggggttccgtttagggggtcgtttacgggcggggtacgggaaccaggtcgtacggaccgtcgtaaggtccacggacccaagggcctccgcccccgtacggtcctacgtccgtccgttaccccgcccgttaccgccgaccacggtccg

SEQ ID NO: 415752 - DNA, 564 bp, Homo sapiens
  misc_feature: GZ8MTXP02FFHQ8.8.43.D10.1.454.CMB.2.raw
  modified_base (218)..(218): a, c, t, g, unknown or other
  modified_base (237)..(237): a, c, t, g, unknown or other
  modified_base (290)..(290): a, c, t, g, unknown or other
  modified_base (373)..(373): a, c, t, g, unknown or other
  modified_base (432)..(432): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcagcactggancagtcaccagtggtactanaccaaactggttccagacagaaactggacaacgcacccaggccactagattanagtaacaaacaacagacactcctcgacccctgccccggtctcacgctccccgtcgttccggggccaaacgctcgccctgaacnctgcaggtgtgacagctggagacggagctagagttactactcgcctgacttctagttgngggtcgggtcgttgggttcgggttcggcgggtacggacgaacgtcgacgaccgtcgacggtcgacgccgaacggcctccggcccctcggtcctacctccgtcgttaccccaccctccgtccaccgcgaccgg

SEQ ID NO: 415753 - DNA, 598 bp, Homo sapiens
  misc_feature: GZ8MTXP02H80M1.8.43.D10.1.454.CMB.2.raw
  modified_base (280)..(280): a, c, t, g, unknown or other
  modified_base (402)..(402): a, c, t, g, unknown or other
  modified_base (486)..(486): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttacatccaatggtcagcaagaacctgacaagcacccagccactgattanagtaacaaacaacaagaacactcctacggaccccctggtaccccggttctcgaacggtccctccccgtccgttaccggggacccaaaaagcctcggaccctggaccacctgtacaggttcgngcgaacgtcccgagacggacgaggcgtagtagtattactgtcctgcttactagttagtggtgggtccgttgggtcgggttcggngggaggaccgaaggcgtacgaccgtcgtaacggtccacgcccgaaaggtcctccgcccccgtcggtcctaccgtccgtccgtccccgtcccttccgaccgaccgaacgccgg

SEQ ID NO: 415754 - DNA, 524 bp, Homo sapiens
  misc_feature: GZ8MTXP02IO4A5.8.43.D10.1.454.CMB.2.raw
  modified_base (290)..(290): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaacaacagacactcctcggacccctgcccggttctcacggcctcccctccttcggggcccaaagctcgccctgacnctgtcaggtgtgcagccctgaggacgaggctgagtattactgcctgctctattagtggtggtcgttgggtgtcggcggaggacaagcgtgaccgtctaggtcagccgacgctcgcccctcggcactcgtcgtccctacctcctcgacacgcg

SEQ ID NO: 415755 - DNA, 571 bp, Homo sapiens
  misc_feature: GZ8MTXP02GBOKH.8.43.D10.1.454.CMB.2.raw
  modified_base (287)..(287): a, c, t, g, unknown or other
  modified_base (364)..(364): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatgttcagcagaacctggacaagcacccaggccactgatttanagtaacaaacaacagacactcctcggacccctgcccgttctcaggctcccttctcggggccaaagctcgccctgacnctgcagggtgtcgcagctgaggacgagcgtgagtattactgcctgctctattagtggttgggtccgttggggtcgggttcgggcgggagggaccgaaggcgtacggtaccgtcgtacggtctacggccgaaacggccgttaccgcccccgttcggtccctacctccgttccggttccccaccccgtcctaccgaccgtaccgaccgg

SEQ ID NO: 415756 - DNA, 561 bp, Homo sapiens
  misc_feature: GZ8MTXP02I1ETC.8.43.D10.1.454.CMB.2.raw
  modified_base (300)..(300): a, c, t, g, unknown or other
  modified_base (373)..(373): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtaacaaanaacagacactcctcgacccctgcccggttctcagtcctccctccgttcggggacccaaagctacgccctgacnctgtcaggtgtgcagcctgaggacgaggctgagtattactgcctgctctattagtggtgggtccgttggggtcggttcggcgggagggaccaaggtcgtgaccgtcgtacggtcgacgtcccgaaggcctcggtcccccgtcggtccacgtccgttccgtcccctacccgtcctaccgacctacgccg

SEQ ID NO: 415757 - DNA, 622 bp, Homo sapiens
  misc_feature: GZ8MTXP02H3PHD.8.43.D10.1.454.CMB.2.raw
  modified_base (281)..(281): a, c, t, g, unknown or other
  modified_base (320)..(320): a, c, t, g, unknown or other
  modified_base (361)..(361): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtgttactatccaactgtccagcaagaactgacagcaccagccactgattanagtaacaaacacagacactcctcggacccctgcccgttncacgcctcccgtcgttcggggaccaacgcctcgccctgacncgtgtacagggtgtgcgagtcccgtaggacggacggaggtaccgtaggaagttacgtttacgtcgtccgtgtccttacgttaagtttacggttcggggttcggggttccggtttgggggtcgggttccggggacgggtacgggaccgtagtcgtaccggtaccgtaccgtacggtacacggtacccgaacggtcccgccgtacccccgtcggttcctaccgttccgtcccgttccccacccgttccgaccgaccgacgccg

SEQ ID NO: 415758 - DNA, 558 bp, Homo sapiens
  misc_feature: GZ8MTXP02F76L6.8.43.D10.1.454.CMB.2.raw
  modified_base (283)..(283): a, c, t, g, unknown or other
  modified_base (289)..(289): a, c, t, g, unknown or other
  modified_base (365)..(365): a, c, t, g, unknown or other
  modified_base (376)..(376): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccacngattanagtacaaacaacagacactcctcggacccctgcccgttctcagctccctcgttcggggccaaagctcgccctgacnctgtcaggtgngcagcctgaggacgaggcgtgagtatactgcctgctctattagtgggtcgggtccgtttgggtcggttcgggacgggagggaccgaagtcgtagaccgtccgtacggtacacggacccgaaacggccgtccgcccccgtacggcctacgtcgtccgttccccgccctccgtccgacacgacg

SEQ ID NO: 415759 - DNA, 549 bp, Homo sapiens
  misc_feature: GZ8MTXP02I0TN1.8.43.D10.1.454.CMB.2.raw
  modified_base (287)..(287): a, c, t, g, unknown or other
  modified_base (326)..(326): a, c, t, g, unknown or other
  modified_base (388)..(388): a, c, t, g, unknown or other
  modified_base (422)..(422): a, c, t, g, unknown or other
  modified_base (431)..(431): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtcccaggagggacagtcactctcacctgtgcttccagcactggagcagtcaccagtgttactatccaaactggttccagcagaaacctggacaagcaccaggccactgatttanagtaacaaacaacagacactctcggacccctgcccgttntcgacgtcctcctccgttacggggaccaaacggtctcgccctacgacacgttcgtcagggtntcgcaggcctgaggacgaggctagagtacttacngcctgcttntattgtggtcggtccttgggtgttcggacggaggtcagcgtcgaccgtcgtggtacacgtaccgaacggtctccgccccgtcgtcaccgtctccgttccaccctcgtacgacacgcgg

SEQ ID NO: 415760 - DNA, 783 bp, Homo sapiens
  misc_feature: GZ8MTXP02H4RU2.8.43.D10.1.454.CMB.2.raw
  modified_base (298)..(298): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccgagtaggttactataccaaactggttccagtacaagaaacctggaccaaagccaacccgaggccaacgtntaattatagtaacaaacgaacagaccactcctacggacccctcgtcccggttactcgacgtcctccccgttcgtccggggacctaaacgtcgtaccgtccctacgaacctcgtacgtccgacggggttgacggaccgtacgtacccgtacggggaacggggaccggtacgggtaccgttaagggtaacgttttaaacgtttacccgtcgggtcctaccgttccgttaacgttaaggtttaacggtttcgggggttacgggggtttccggtttacgggggttcggggtttaccgggggaaccgggggtaacgggtaacccgaaagggtccgttaacccggttacccggtacgttaaccgggtaccggtacggaccccggtaaacggtccccgttacccggtccccccgttacggtacccctaccgttccccgttacccggttaccccctacccgtaccccgtacccggtaaccgaaccgtccgggg

SEQ ID NO: 415761 - DNA, 557 bp, Homo sapiens
  misc_feature: GZ8MTXP02GPJIW.8.43.D10.1.454.CMB.2.raw
  modified_base (291)..(291): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagttggttactatccaaactggttccagcagaaacctggacaagcacccaggccactgatttanagtaacaaacaacagacactcctggacccctgcccggtctcagcctccctcgtcggggaccaaagctcgccctgacnctgtcaggtgtgcagcctgaggacgagctgagtatactgctgctctattagtggtggtcgttgggtggttcggcggtaggacgaaggctacggaccgtcgtaggtcacggtcccgaacggccaccgtcccccgtcggtccaccgtccgtccgttcccccggtccctcccgtaccgacctaccggaccgg

SEQ ID NO: 415762 - DNA, 537 bp, Homo sapiens
  misc_feature: GZ8MTXP02J2FAP.8.43.D10.1.454.CMB.2.raw
  modified_base (163)..(163): a, c, t, g, unknown or other
  modified_base (285)..(285): a, c, t, g, unknown or other
  modified_base (325)..(325): a, c, t, g, unknown or other
  modified_base (361)..(361): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggagcagtcaccagtgttactatccaaactggttccagcagaacctggacagcaccaggccatgatttanagtacaaacacagacactcctggaccccctgccccggttntcaggcctccctcttcggggccaagctgccctgacnctgcaggtgtgcagccctgaggacgaggctgagtattactgcctgctctattagtggtgggtccgttgggtgttcgggcggacgggaccaaggcgtagaccgtccgtaggtcacgcccgaaggcctcgccccctacggtccacctcgtcgttccccacccgtcctaccgacacgcg

SEQ ID NO: 415763 - DNA, 690 bp, Homo sapiens
  misc_feature: GZ8MTXP02FM6FG.8.43.D10.1.454.CMB.2.raw
  modified_base (258)..(258): a, c, t, g, unknown or other
  modified_base (275)..(275): a, c, t, g, unknown or other
  modified_base (281)..(281): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactataccaaactgtcagcagaacnggacaagcaccagcacngattanagtacaaacaacagacactccgtacggacccctcgtcccgttctacgacggcctaccccgttccggttaccggggacccaaaacggtcctacggtccccgtacgaacctaccgtcgtccgtaagggtcgtcggacaacggtcccgtagggacgggaaccggagggtaccgtagtaacgttacttaaccgtgtacccgttgtaccttacgttaagtttaggtgggttcgggttccggtttggggttcggttacggggaccgggtaacgggaaccgaacggtaccgtcggtaaccgttaccgtaacggtcccgaacggtacccgaacggtccccgttccggacccccgttcggtccctaccgtccgttcccgttcccccgtaccccgttccgtaccgaccgacggtaccgg

SEQ ID NO: 415764 - DNA, 617 bp, Homo sapiens
  misc_feature: GZ8MTXP02JOCC6.8.43.D10.1.454.CMB.2.raw
  modified_base (286)..(286): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcaccagccactgattanagtaacaaacaacagacactcctcggacccctgaccccggttctcgaggtcctcccgtcgtccggggaccaaacgctcgccctaggacacttgtcgagggtgtgcgacgccgtaggaggtaacggaggacgtagagttacttactcgctgctacttattacgtgggtcggtccgttggggtgttccgggagggtacgggaacgaaggtcgtacggtacccgtaccgtaacggtccgaccggaccccgtaaaggtcccgtccggtcccccgttcggtaccctaccttccgtccgtttcccccgacccgtcccttaccgaccgacggacccgg

SEQ ID NO: 415765 - DNA, 635 bp, Homo sapiens
  misc_feature: GZ8MTXP02GI77G.8.43.D10.1.454.CMB.2.raw
  modified_base (263)..(263): a, c, t, g, unknown or other
  modified_base (293)..(293): a, c, t, g, unknown or other
  modified_base (388)..(388): a, c, t, g, unknown or other
  modified_base (405)..(405): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactataccaaactggtccagacagaaaccnggacaaagccaccgaggaccactgatttanaagtaaacaaacaacacgactacctccgtacggacccctcgcccggttctcgacggtccctcccgtccgttcggggaccaaacggctcgccctanacctactgtcagggttncgcgacgcccgtagacgggaccgaggcgtaggaagttactactcggtcctgcttacttagttacgtgggttcgggtcgttggggtcggttcggggacgggacgggaacgacggtacgtccggtaccgtcgttacggaccgacgaccggaaacggtccgtcccggtccccgtccggtaccgtaccttccggttcccgttccccgtcccctccgtacccgacgaccggccgg

SEQ ID NO: 415766 - DNA, 596 bp, Homo sapiens
  misc_feature: GZ8MTXP02JCH60.8.43.D10.1.454.CMB.2.raw
  modified_base (220)..(220): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggtccagcagaaacctggacaagcacccaggccactgtatttatagtaacaaacaacagacactcctcggacccctcggcccggttctcacggtcctccccgttccgttccgggggacccaaaacggtcctcggccccttacgacctcgtacgtcgaggtgtcgcacgccgtggaggacgaggcgtggagttatcgtacgtctgctcttagttagtggggtcggtccgttggggttggttacgggcgggacgggaccgaggtctggaccgtcgtaggtcgacgaccgtaacggcctccggccccgtcggtcctacgtccgtcgttccccacctccgtaccgacgcgacg

SEQ ID NO: 415767 - DNA, 525 bp, Homo sapiens
  misc_feature: GZ8MTXP02FLECO.8.43.D10.1.454.CMB.2.raw
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgccccggttctcaggctcccctccttggggccaaagctgcccctgacnctgtcaggtgtgcagccctgaggacgaggctgagtatactgcctgctctattatggtgggccttgggtgttcggcggagggaccaagctgaccgtctaggtcagcccaaggcctcgccccctcggcactctcgttccccaccctcctcgaccacgcg

SEQ ID NO: 415768 - DNA, 573 bp, Homo sapiens
  misc_feature: GZ8MTXP02JSHJX.8.43.D10.1.454.CMB.2.raw
  modified_base (284)..(284): a, c, t, g, unknown or other
  modified_base (361)..(361): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtcagcagaacctggacaagcaccagcactgatttanagtaacaaacaacagacactcctcggacccctgcccggttctcgagcctccctcgtcggggccaagctcgcctgacnctgtcaggtgtgcgagccctagaggacggaggtcgtgtagtattactgcctgcttctattagtcgggtgggttccgttggggtcggttcgggcgggtacgggaccgaaggcgtaggtacccgtccgtaacggtccgaccggcccgaacggccgtccgcccccgtcgtccgtacctccgttccgtcccctcccctccgtaccgaccacggccg

SEQ ID NO: 415769 - DNA, 606 bp, Homo sapiens
  misc_feature: GZ8MTXP02GY6H6.8.43.D10.1.454.CMB.2.raw
  modified_base (286)..(286): a, c, t, g, unknown or other
  modified_base (365)..(365): a, c, t, g, unknown or other
  modified_base (377)..(377): a, c, t, g, unknown or other
  modified_base (429)..(429): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtcgtccccaggagggacagtcactctcacctgtgcttccagcactggagcagtcaccagtgttactatccaaacgtgtcagcagaacctggacaagcaccagccactgattanagtaacaaacaacagacactcctggacccctgcccgttctcacggcctccctcgtccggggccaaagctcgccctgacncgtgtcagggtntgctacggccgtagacggacgagcgttggagttactacgtgccctgtacctntagttagtgggtcggtccgtttggggtcgggtttacgggcgggtaacgggaccgaaaggtccgtaacggtccgtcgtaacgggtacgacgtacccggaaacggcccgtccgcccccgttcggtaccctaccgttcccgtaccggttccccctacccgtcctaccggaaccgcgccgg

SEQ ID NO: 415770 - DNA, 696 bp, Homo sapiens
  misc_feature: GZ8MTXP02GYZJ5.8.43.D10.1.454.CMB.2.raw
  modified_base (163)..(163): a, c, t, g, unknown or other
  modified_base (272)..(272): a, c, t, g, unknown or other
  modified_base (292)..(292): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtcccaggagggacagtcactctcacctgtgcttccagcactggagcagtcaccgagtggttactactccaaactggttccagacagaaacctggacaanccaccaggccactgatttanagtacaaacacagacactctcggaccctcgtccgtctccaggtcctacccgtccgttacggggacccaaagcctcggccctagaacctctcgtacgacgggtcgtacgacgacggcccgtaggaacggtacggacggtctacggtaacgttacgttacgtcgtcccgttagtacttacgttaaatttcggttcggggttacgggttccgtttagggggttcggtttaccggggacgggtaacgggtaccgtaacgggccgttacggaacccgtttcggtaaacggtccgtaacggaccccggtaacgtcccggttcccgtacccccggtacggttacccgtacgttcccgtcccggtttaccccgtaccccctaccgttaccggtaccgtacccgggtaaccgg

SEQ ID NO: 415771 - DNA, 598 bp, Homo sapiens
  misc_feature: GZ8MTXP02GRJU4.8.43.D10.1.454.CMB.2.raw
  modified_base (287)..(287): a, c, t, g, unknown or other
  modified_base (364)..(364): a, c, t, g, unknown or other
  modified_base (373)..(373): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttccagcagaaacctggacaagcaccagccactgatttanagtaacaaacaacagacactcctcggacccctgacccgtctcgacgctccctcgtcgggaccaagctcgccctgacnctgcaggtntgcagcctagaggacgagctgagttatacgtcgcctgctcttagttacgtgggttcgggtccgttggggttcgggttcggggacgggagggaaccgtaaggcgtacggacccgtacgtacggtaccaccggacccgaaacggcccgtccggcccccgttcggtccctaccgttccttacccggttacccccctacccttcccgtaccgaacccgtaccggcccgg

SEQ ID NO: 415772 - DNA, 563 bp, Homo sapiens
  misc_feature: GZ8MTXP02IHSGD.8.43.D10.1.454.CMB.2.raw
  modified_base (286)..(286): a, c, t, g, unknown or other
  modified_base (437)..(437): a, c, t, g, unknown or other
  modified_base (460)..(460): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctccacctgtgcttccagcactggagcagtcaccagtgttactataccaaactggtccagcagaaacctggacagcaccagccactgattanagtacaaacacagacactccgcggacccctgcccggttctcgagtcctccctcgtcggggaccaaaggctacggccctgctacgtgtacacggtgcgcagcctgaggacgagggctgagtaactcgtgcctgtctcttagtgtggtcggtnttgggtgttacggcggtaggacngcgtacggaccgtcgacgtcgacgtcccgacggtcaacccggttccccgcggtaccctcctcgttcccgttcccgaccctcccgtacggaccaaccggtccgg

SEQ ID NO: 415773 - DNA, 590 bp, Homo sapiens
  misc_feature: GZ8MTXP02JB571.8.43.D10.1.454.CMB.2.raw
  modified_base (288)..(288): a, c, t, g, unknown or other
  modified_base (307)..(307): a, c, t, g, unknown or other
  modified_base (326)..(326): a, c, t, g, unknown or other
  modified_base (372)..(372): a, c, t, g, unknown or other
  modified_base (387)..(387): a, c, t, g, unknown or other
  modified_base (416)..(416): a, c, t, g, unknown or other
  modified_base (423)..(423): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccagccactgattanagtacaaacaacagacacncctggacccctgcccgttntcacgtctccctccgtcggggacccaaagcctcggccctacggacncgtgtacagggtcgngcagccctgaggacgaggctggatatacngctgctntatagtggtggtcgtgggtgttcggacggaggacccgaagtctacggaccgtcgtaaggtccgacgacccgaacggtccgtccggtacccccgttccgggtacctaccgttccgttcccggttcccccggtaccccttcccgtacccggtaccgaacccggtcccgg

SEQ ID NO: 415774 - DNA, 540 bp, Homo sapiens
  misc_feature: GZ8MTXP02FGUWS.8.43.D10.1.454.CMB.2.raw
  modified_base (289)..(289): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggtactatccaaactggttccagcagaaacctggacaagcacccaggccactgatttanagtacaaacaacagacactcctggacccctgcccggttctcacggctcccctcgttcggggaccaaagctacgccctgactcngtcagggtgtgcagcctgaggacgagctgagtatactgcctgctctattagtgggtcgggtccttggggtggttcggcgggtaggaccaagctagaccgtccgaggtcacgccctaaacggtccgccccgtcggtccactctcgtcccaccctcctcgacacgcgacg

SEQ ID NO: 415775 - DNA, 593 bp, Homo sapiens
  misc_feature: GZ8MTXP02GEF6A.8.43.D10.1.454.CMB.2.raw
  modified_base (330)..(330): a, c, t, g, unknown or other
  modified_base (370)..(370): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgattatagtaacaaacaacagacactctcgacccctgcccggttcncacggcctccctccgttcggggccaaagctcgccctgacnctgtcaggtgtgcagcctgaggacgagctgagtatacgtgcctgctctattagtgggtggtccgttgggtcggttcgggcgggtaacgggaccaaggcgttacgaccgttcccgtaacggtccgacggacccgaaacggccgtcgtccccccgttcggtccctaccgttccgttacccgtttcccccacccccgtttcccgtaccgtacccgaccgtacccgg

SEQ ID NO: 415776 - DNA, 586 bp, Homo sapiens
  misc_feature: GZ8MTXP02GEDY2.8.43.D10.1.454.CMB.2.raw
  modified_base (290)..(290): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagttggttactataccaaactggttccagcagaaacctggacaagcaccagccactgattanagtaacaaacaacagacacctcctcggacccctgccccggttctccgacgcctccctcgttccggggaccaaagctcgccctagacactgtctaggtcgtgcacgccgtagacggacgaggctagagttatactgctgctcttattagtggtcggtcgttgggtcgggttcggacgggacggacgaacgcgtacgtaccgtctaggtaccacggacccgaacggcctaccgtcccccgtccggtcctaccgtccgttcccgttcccccacccctcccgtaccgaccgaccgaccgg

SEQ ID NO: 415777 - DNA, 572 bp, Homo sapiens
  misc_feature: GZ8MTXP02G9CGS.8.43.D10.1.454.CMB.2.raw
  modified_base (285)..(285): a, c, t, g, unknown or other
  modified_base (324)..(324): a, c, t, g, unknown or other
  modified_base (363)..(363): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtcagcagaacctggacaagcaccagccactgatttanagtacaaacaacagacactccgtcgacccctgcccgttncgagcctccctcgtccggggaccaacgctcgccctgacncgtgtcgaggtgtcgcacgcccgtagacggacggaggcgtagagttattacgcgtcctgctctattaggtgggtcgggtcgttggggttcgggttcggacgggtacggacgagtcgtcgaccgtcgtacggtcacggcccaggtccgtccgtccccgtcggtcctaccgttccgtccgttccccacccgttcctaccgaccgacgaccg

SEQ ID NO: 415778 - DNA, 603 bp, Homo sapiens
  misc_feature: GZ8MTXP02IIFLG.8.43.D10.1.454.CMB.2.raw
  modified_base (328)..(328): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtggttactataccaaactggtccagcagaaacctggacaagcaccaggccactgattatagtacaaacaacagacactctggacccctgcccgttcncaggtcctccctcgttcgggaccaaacgctacgccctgaccacgtgtactaggtgtcgcgacgctagacggacgaggctgagttattactgctcgactactattagtggtcggtacgttggggtcggttcgggacgggtacgggaccgaacggccgtaccgtccgtacggtccacggacccgaacgggtcctccggtcccccgtcggtaccctaccgttccgttaacccgttcccccgaccccgttaccgacccgaccggaccgtacgtacccgg

SEQ ID NO: 415779 - DNA, 552 bp, Homo sapiens
  misc_feature: GZ8MTXP02F41Z3.8.43.D10.1.454.CMB.2.raw
  modified_base (293)..(293): a, c, t, g, unknown or other
  modified_base (371)..(371): a, c, t, g, unknown or other
  modified_base (410)..(410): a, c, t, g, unknown or other
  modified_base (542)..(542): a, c, t, g, unknown or other
  modified_base (547)..(547): a, c, t, g, unknown or other
tcagctcgcgtgtccacgaccggtgctcgatttagactagcagtaagggggcgccaggggtcccttccaatatcagcaccatggcctggactcctctctttctgtccctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaaagccacccgaggccactgatttanaagtaacaaacaaacagacactcctcggacccctgcccgttctcagcctcctccgttcgggccaaagctgccctgacnctgtcaggtgtgcagcctgaggacgaggctgagtatacngtcctgctctattacgtggtcgggtccgttggggtcggttcggcgggacggtaccaaagccgtgaaccgtccgtaggtcacgccgaaacgccgtccgcccccgttgccgtactccgtccgtcccgccctccncgacncgacg

SEQ ID NO: 415780 - DNA, 589 bp, Homo sapiens
  misc_feature: GZ8MTXP02IAMN8.8.43.D10.1.454.CMB.2.raw
  modified_base (221)..(221): a, c, t, g, unknown or other
  modified_base (229)..(229): a, c, t, g, unknown or other
  modified_base (257)..(257): a, c, t, g, unknown or other
  modified_base (278)..(278): a, c, t, g, unknown or other
  modified_base (288)..(288): a, c, t, g, unknown or other
  modified_base (296)..(296): a, c, t, g, unknown or other
  modified_base (301)..(301): a, c, t, g, unknown or other
  modified_base (314)..(314): a, c, t, g, unknown or other
  modified_base (569)..(569): a, c, t, g, unknown or other
tcagctcgcgtgtccacgaccggtgctcgatttagactagcagtaaggggagcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcacgtggancagtcacngtgtactatccaaatggtcagcagaacngacagcaccagcactgattanagtaacaaanaacagacnctccncgaccctgccgtncacggtctcctccgtcgggaccaacgctgcctcgactcgtgtccgagtgtcgcacgcccgtagacggacggacggcgtagtagtacttaacgtcgtccttggtcttacgttagtttacggttggggttcggggttccgtttgggggttcggtttcggggacgggagggtaccgagtccgtacgtacccgtcgttacggacgtacgaccgtaacgccgtaccgccccgttcggtccaacgttcctaccggtacccncctcccgtacgaccacccgg

SEQ ID NO: 415781 - DNA, 586 bp, Homo sapiens
  misc_feature: GZ8MTXP02GY5FI.8.43.D10.1.454.CMB.2.raw
  modified_base (280)..(280): a, c, t, g, unknown or other
  modified_base (293)..(293): a, c, t, g, unknown or other
  modified_base (302)..(302): a, c, t, g, unknown or other
  modified_base (317)..(317): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcacagtgttactatccaaactgtccagcagaaactgacagcaccagccatgattanagtaacaaacaanagacactcncgacccctgtccgtncacgcctccctcgtcgggaccaacgctcgccctgacctctcgtcgtaggtcgtgcgagccgtagacggacggagcgtagagttattacgcgcctgtctcttattacggtggtcgggtcgtttggggtcgggttcgggacggggacgggaccgtaaggtccgtacggtaccgttccgtacgggtccacggacccgaacggtccgtccggtcccccgtacggtccctacgtccgtcgttcccccgcccttccgtccgtaccgtacggaccg

SEQ ID NO: 415782 - DNA, 599 bp, Homo sapiens
  misc_feature: GZ8MTXP02JB36F.8.43.D10.1.454.CMB.2.raw
  modified_base (219)..(219): a, c, t, g, unknown or other
  modified_base (281)..(281): a, c, t, g, unknown or other
  modified_base (355)..(355): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgtactatccaactggtccagcagaaactgacaagcaccagccactgatttanagtacaaacaacagacactctggacccctgcccggtctcagcctcctcgttcggggccaaagctcgccctgacnctgtcaggtgtgcagccctagaggacgagctgaagttactacgtcgaccgttgcttacgtaatttgtgggtcgggttccgttgggggttcgggtttaccggggacggggaacggggaccgtaaacggtcgtcggtaaacccggtccgtacgggtacacggaccccgaaacggcctacggtcccccgtcggtcctaccgtccgttccggttcccgtacccctcccgtccggtaacccgccggacg

SEQ ID NO: 415783 - DNA, 531 bp, Homo sapiens
  misc_feature: GZ8MTXP02FRXI2.8.43.D10.1.454.CMB.2.raw
  modified_base (290)..(290): a, c, t, g, unknown or other
  modified_base (299)..(299): a, c, t, g, unknown or other
  modified_base (328)..(328): a, c, t, g, unknown or other
  modified_base (367)..(367): a, c, t, g, unknown or other
  modified_base (376)..(376): a, c, t, g, unknown or other
  modified_base (413)..(413): a, c, t, g, unknown or other
  modified_base (420)..(420): a, c, t, g, unknown or other
  modified_base (500)..(500): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttanagtacaaanaacagacactcctggacccctgcccgttntcaggctccctcctcggggcccaaagctcgccctgaccnctgcaggtntgcagccctgaggacgagctgagttatactgctgctntattagnggtggtccttggggtgttcgggcggagggaccagcgtcgaccgtcgtaggtcacgcccaaggctcgcccccgtcggtccnctccgtcgtcccaccctcctcgaccacgccg

SEQ ID NO: 415784 - DNA, 729 bp, Homo sapiens
  misc_feature: GZ8MTXP02GEPEO.8.43.D10.1.454.CMB.2.raw
  modified_base (287)..(287): a, c, t, g, unknown or other
  modified_base (325)..(325): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtcagcagaaacctggacaagcacccaggccactgatttanagtacaaacacagacactcctgacccctgcccggttcncacggtcctccctccgttcggggaccaaagctacgccctagacaccgtgtacgagggtgtacggctacgcccgttaggacgggaacggacgggtccgtaggtaacgttactttaccgtcggtacccttaggtcctttacgttaagtttacggttgggggtttcgggggttccggtttttcgggggttcgggtttcgggggacccgggggtaacggggtaacccgtaaaacgggtccgttcgggtaaccccggttacccggttaacggggttaccgaccggaccccgtaaaacggggtccccttaccgggtaccccccgttccgggtacccgttaaccctcccgtttcccgttaccccccgttacccccttaaccccgtcccgtaacccgtaacccggtcccggg

SEQ ID NO: 415785 - DNA, 541 bp, Homo sapiens
  misc_feature: GZ8MTXP02FTRLL.8.43.D10.1.454.CMB.2.raw
  modified_base (289)..(289): a, c, t, g, unknown or other
  modified_base (368)..(368): a, c, t, g, unknown or other
  modified_base (393)..(393): a, c, t, g, unknown or other
  modified_base (531)..(531): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttccagcagaaacctggacaagcacccaggccactgatttanagtaacaaacaacagacactcctggacccctgcccggttctcagcctccctccgtcggggccaaagctcgccctgaccnctgcaggtgtgcagcctgaggacgnggctgagtatacgtgcctgctctattagtggtcgggtcgttgggtacggttcggacgggtacgggacaaggctcggaccgtctaggtccaggaccaaggcctcgccccgtcggtcacctcgtccgtcccgcccttccncgacacgccg

SEQ ID NO: 415786 - DNA, 574 bp, Homo sapiens
  misc_feature: GZ8MTXP02GM22Z.8.43.D10.1.454.CMB.2.raw
  modified_base (292)..(292): a, c, t, g, unknown or other
  modified_base (333)..(333): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgccttccagcacgtggagcagtcaccagtggttactatccaaactggttccagcagaacctggacaagccaccaggccactgatttanagtaacaaaacacagacactcctcggacccctgcccgttcncacgtcctccctcgtcggggaccaagctcgccctgacactgcgtaggtgtcgctagccctaggaggacgaggactagtaagttatacgtgacctgctctattagtggtcgggtcgttgggtggtcggacggagggaccagctcgaccgtcgtacggtcacggacccgacggcctcccggcccctaccggtctacccgtccgttcccgttccccgccctacccgtacgaacccgtcgaccgg

SEQ ID NO: 415787 - DNA, 720 bp, Homo sapiens
  misc_feature: GZ8MTXP02H7596.8.43.D10.1.454.CMB.2.raw
  modified_base (574)..(574): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtcccaattctcagactgtggtgactcaggagccctcactgactgtcgtccccgaggagggacagtcactctcacctgtgcttccagcactggacgcagtcacctagtggttaactactaccaaacgttcggttcccagacaagaaaccgtggaacaagccacccgaggccactgtatttaacagtaaacaaacaacacgaccaactcctaccggacccctacggtccccgttctacgacgtccctacccgtccggttccggggacctaaaacgtccgtcggaccctagaacctacgtcggttaccgaggggttcgtcgacgacgtacccgtacggacggggacggtaacgggtccgtagtaacgtttattaaccgtcgttactcgttcttacgttagtttaggtcggggttacgggtttcggtttgggggtcgggttaccggggnggggtaaaccggacgtaacggcgttaccgggtaccgtacggtacggtaccgaccggtaccgtacggccccgtaccgtacccccgtacggtcctaacccgttccgttccccgtcccctaaccgtcccgtaccgaccgaccggaccgg

SEQ ID NO: 415788 - DNA, 836 bp, Homo sapiens
  misc_feature: GZ8MTXP02GYZHQ.8.43.D10.1.454.CMB.2.raw
  modified_base (289)..(289): a, c, t, g, unknown or other
  modified_base (338)..(338): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttccagcagaaacctggacaagcacccagccactgatttanagtaacaaacaacagaccactccgtcggaccccctcggtccccggttcnccgacggtccctccccgttccgttccggggacccaaaaggtcctcggccccctagacccacgttgtaccgagggttcgtcggactacggtcccgtagggaacgggaccggaacgggtccgttaggtaacgtttaacgttaacccggtacggtcccgttacggttaccttaccgtttaaaggtttacggtttcgggggtttacgggggtttcccgggttttacggggggtttccgggggtttaccgggggaaccgggggtaaaccgggggtaacccggttaaaacggggtcccggtttacggggttaacccccgggtttacccgggttaacggggttacccggtaacccgggtaacccccggaaacggggtcccccgttccccgggtacccccccggttcccgggttaccctaaccccggtttcccgtttaccccggtttacccccccgtaacccccgttttccccggtacccggaaacccggtcccggtaacccgggg

SEQ ID NO: 415789 - DNA, 687 bp, Homo sapiens
  misc_feature: GZ8MTXP02GSXTN.8.43.D10.1.454.CMB.2.raw
  modified_base (316)..(316): a, c, t, g, unknown or other
  modified_base (370)..(370): a, c, t, g, unknown or other
  modified_base (399)..(399): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtcgcttccagcacgtggagcagtcaccgagttcggttactactaccaaacgttcggttaccagacaacgaaaccgtggaacaacgccaacccgaggacctactagtaatttanaacgtaaacaaaacaacacgaacacctccgtacggtacccctcggtcccgttcncgacgtcctccgtcgtccgggaccaagcncgcctagactcgtgcgaggttcgcgcacgtccgaggacggacgaggcgtagtagttataccgtcgtaccgtgtacctgtttaagttggttcgggggttcggttcgggttcgggggttacgggttaccgggacggggaaaccgggtaccaacggtcgttaccggaccggttacggtaacggttaccaccggaccggtaccggtcccgtacccggtcccccgtacggtacccttccgtcccgtttaccccgttaccccacccgttacccgacccgtacgtacggacccgg

SEQ ID NO: 415790 - DNA, 570 bp, Homo sapiens
  misc_feature: GZ8MTXP02IT7T1.8.43.D10.1.454.CMB.2.raw
  modified_base (290)..(290): a, c, t, g, unknown or other
  modified_base (371)..(371): a, c, t, g, unknown or other
  modified_base (455)..(455): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagttggttactatccaaactggttccagcagaaacctggacaagcaccaggccactgatttanagtaacaaacaacagacactcctggacccctgcccggttctcgaggcctcctccgttcggggaccaaagctcgccctgacnctgtcaggttgcgcagcctggagacgagctgagttattactgcctgctcttattagtgggtgggtctttagggtcggttcgggngagggaccgaagcgtacggccgtcgtagggtcacggtacccgaggtcctcggtcccccgtcggtccctactccgttacccgttccctaacccctccgttaccgaccacggtccgg

SEQ ID NO: 415791 - DNA, 566 bp, Homo sapiens
  misc_feature: GZ8MTXP02HYAH3.8.43.D10.1.454.CMB.2.raw
  modified_base (289)..(289): a, c, t, g, unknown or other
  modified_base (364)..(364): a, c, t, g, unknown or other
  modified_base (375)..(375): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcaagaaacctggacagccaccaggccactgattanagtaacaaacaacagacactcctcggacccctgcccggttctcacgctccctcgtcgggccaagctgccctgacntgtcaggtgtncagcctggaggaccggagcgtagagtacttacgtgtctgtcttctattagtgggttgggtccgttggggttggttcgggcggacgggtaaccaggcgtacgaccgtaccgtacggtccgacgacccgtaacgcctccgcccccgtcggtccctaccgtcgtccgtccccaccctccgtaccgactaccgcg

SEQ ID NO: 415792 - DNA, 645 bp, Homo sapiens
  misc_feature: GZ8MTXP02GWY74.8.43.D10.1.454.CMB.2.raw
  modified_base (293)..(293): a, c, t, g, unknown or other
  modified_base (385)..(385): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtgtccccaggagggacagtcactctcacctgtgcttccagcactggagcagtcaccagtggttactatccaaactggttccagcagaaacctggacaagccacccaggccactgatttanagtacaaacaacagacacctcctcggacccctcggcccggttctccgacggcctccccgtccgttccggggaccaaagctcgccctagaccnctcgtcagggtgtcgacacgcccgtaggacgggacgagggctggagttattacgcgtcctgcttcttattagtgggtcgggttccgttggggttacgggttccggggacgggtacgggacccgaaggtcccgtacggtacccggttcgtaacgggtaccacggaccccgaaacgggtccccgtccggccccccgttcggtaccctaccgttccgttcccgttacccccgtacccttcccgtaccgacccgaccggtccgg

SEQ ID NO: 415793 - DNA, 570 bp, Homo sapiens
  misc_feature: GZ8MTXP02G00K7.8.43.D10.1.454.CMB.2.raw
  modified_base (165)..(165): a, c, t, g, unknown or other
  modified_base (221)..(221): a, c, t, g, unknown or other
  modified_base (289)..(289): a, c, t, g, unknown or other
  modified_base (301)..(301): a, c, t, g, unknown or other
  modified_base (308)..(308): a, c, t, g, unknown or other
  modified_base (538)..(538): a, c, t, g, unknown or other
tcagctcgcgtgtccacgaccggtgctcgatttagactagcagtaaggggggcgccgaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgcttccagcactggancagtcaccagtggttactatccaaactggttccagcagaaacctggacaagcaccagccactgattanagtacaaacaanagacacncctggacccctgtcccggttctcaggcctcccgtcgtccggggaccaaagctacgccctagaccacgtcgtctagggtcgtgacagtcccgtagaggaccgaggctagagtattacgtgacctgctctagttagtggtcgggtccgtttgggtcggttcggcggtaacgggtaccgaagtcgtacgtaaccgtcgtaaggtcacggccgaaggcctcgaccccgtcgacnccgtctcgttcccactccgtacgacacggtcg

SEQ ID NO: 415794 - DNA, 605 bp, Homo sapiens
  misc_feature: GZ8MTXP02IJW0B.8.43.D10.1.454.CMB.2.raw
  modified_base (253)..(253): a, c, t, g, unknown or other
  modified_base (273)..(273): a, c, t, g, unknown or other
  modified_base (358)..(358): a, c, t, g, unknown or other
  modified_base (361)..(361): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttcagcactggagcagtcacagtcgttactaccaactgtcagcagaacngacagcaccagcatgattanagtaacaacaacagacactcctcgacccctgcccgtctcacgcctcctccgtgggacccaacgctcgcctgacactgtcaggtgngcncgctggagacgaggctagtagttacttacgtcgtcctagtcttactagtttagtgggttcgggttccggtttgggggtcgggttcggggacgggtacgggaaccgacggtacgtcggtacccggttaccgtacggtaccgaccggtacccggacggtcccgtcccgtcccccggtccgtcctaccgttcccgtcccgttacccccgtaccccgttcccgtaccgacccgaccggaccgtaccgg

SEQ ID NO: 415795 - DNA, 555 bp, Homo sapiens
  misc_feature: GZ8MTXP02H1DBO.8.43.D10.1.454.CMB.2.raw
  modified_base (293)..(293): a, c, t, g, unknown or other
  modified_base (321)..(321): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttacatccaaatggttccagcagaactggacaagcaccaggccactgattatagtacaaanacagacactctgacccctgcccggttcncacgctccctccttccggggccaaagctcgccctgacactcgcagggtgtgcgagccctggaggacggaggtctgagtattactgcctagcttctattagtggttgggtccgttggggttcgttcgggcggacgggacgacgcgtggaccgtcgtaacggtcgacgcccgaaggccgtccgccccgtcggtcctacgtccgtccgtacccctaccctccgtccgacgacgtccg

SEQ ID NO: 415796 - DNA, 573 bp, Homo sapiens
  misc_feature: GZ8MTXP02GMC5P.8.43.D10.1.454.CMB.2.raw
  modified_base (288)..(288): a, c, t, g, unknown or other
  modified_base (327)..(327): a, c, t, g, unknown or other
  modified_base (362)..(362): a, c, t, g, unknown or other
  modified_base (372)..(372): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaatggttcagcagaaacctggacaagcacccaggccactgatttanagtaacaaacacagacactcctggacccctgcccggttntcagctccctcgtcggggaccaagctgccctgacnctgtcaggtntgcagcctgaggacgtagctagaagtacttactgacctgtcctcttattagtggtcgggtccgtttggggtggttcgggacgggtagggaccgagtcgtcggaccgtccgtaggtcacgtacccgaacggtcctccgcccccgttcgtacctaccgtccgttccgttaccccgtccccctccgtaccgaccgaccgaccgg

SEQ ID NO: 415797 - DNA, 674 bp, Homo sapiens
  misc_feature: GZ8MTXP02I1YZN.8.43.D10.1.454.CMB.2.raw
  modified_base (301)..(301): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgccccagggtccaattctcagactgtggtgactcaggagcccctcactgactgtcgtccccaggagggacagtcactctcacctgtgcttccagcactggagcagtcaccagttgttactactaccaaacttggttccagcaacgaaacctggacaagccacccgaggccactgaatttanagtaacaaacaacagaaccacctcctacggaccccctcggtccccgttctccgacgccctccctccgtcggggacccaaagcctcgccctacgactcgtcgtacgagggtgtcgacacggccgtaggaggacggagacgtaggtaagttacttaccgtcgtcccgttgaccttacttaacggtttaggttcggggttcggggttccggtttcgggggttcgggttccgggacggggtacgggaccgtaacggtcgacggttacccggtcgtaacggtccgacggacccgtacggtcccgtcccgtcccccgttacggtcctaccgttccgttcccgttaccccctacccgtccgtaccggaccgcggtaccgg

SEQ ID NO: 415798 - DNA, 575 bp, Homo sapiens
  misc_feature: GZ8MTXP02FFMTA.8.43.D10.1.454.CMB.2.raw
  modified_base (288)..(288): a, c, t, g, unknown or other
  modified_base (329)..(329): a, c, t, g, unknown or other
  modified_base (370)..(370): a, c, t, g, unknown or other
  modified_base (382)..(382): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgttactatccaaatggttccagcagaaacctggacaagcacccgaggccactgatttanagtaacaaacaacagacactcctcggacccctgcccggttntcgagccttccctcgttcggggaccaaagctcgccctgacnctgtcaggtgtncacgcctgaggtacgaggctgagttatactgccttgcttactagttagtgggtcgggtccgttggggtcggttcgggcggaagggtaccgaagtcctaggacccgtcgttacggcgacggtacccgaaacggcctccgtcccccgtcggcctaccttccgtcgttcccccacccgtccctaccgacaccgacg

SEQ ID NO: 415799 - DNA, 688 bp, Homo sapiens
  misc_feature: GZ8MTXP02JIQUN.8.43.D10.1.454.CMB.2.raw
  modified_base (318)..(318): a, c, t, g, unknown or other
  modified_base (360)..(360): a, c, t, g, unknown or other
  modified_base (403)..(403): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagcctgtggtgactcaggagccctcactgactgtcgtccccgaggagggacagtcactctcacctgtcgtcttccagcacgtggagcagtcacctagttacggttaactactaccaaacgttcggtaccagcaacgtaaaccctggaacaacgccaacccgaggaccactgtatttaanagtaacaaacaacagaccactccgtcgacccctggcccgttncgacggtcctccctcgtccggggacaaacgctcgcctcggacncgtgtaccgagggttcgcgcctaacggtcccgtacggaacgggtaacggtacgggtccgtaggtaacgtttacgaaacgttacgtcggttcctacgttacctttacgttaggttcgggttcgggttcgggttcgggttcgggggttcgggtaccggggtaacgggacggtacgtaacggtccgtaccgtaccgtacgtacggaacccggtttaacccggcgtccgtcccgtcccgtcgtaccgtccgtccgttccccgtcccgtacccgtcccgtacgacgccgg

SEQ ID NO: 415800 - DNA, 619 bp, Homo sapiens
  misc_feature: GZ8MTXP02G1RZB.8.43.D10.1.454.CMB.2.raw
  modified_base (299)..(299): a, c, t, g, unknown or other
  modified_base (302)..(302): a, c, t, g, unknown or other
  modified_base (325)..(325): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccagcactggagcagtcaccagtgttactatccaaactgtccagcagaactggacaagcacccagccactgatttatagtacaaacaacanacnctactggacccctgcccggttcncgagcctcccgtcgtacggggcccaaagcctagcccctagaccactcgtacgaggtcgtacgcacgtccctagaggacggacgcgtaggagttagttacgtcgtacgtgccttacgttactttagtgggttcggtcgtttgggttcggtttccggggacggagggtaaccgaacggtccgtacggaaccgtcgtacggtacgtacggacccgtacggtccgtacccggtccccgtccgggttcctccttccgttcccgttccccgtcccgttccctacccgacgtacccgacgg

SEQ ID NO: 415801 - DNA, 597 bp, Homo sapiens
  misc_feature: GZ8MTXP02JYNMO.8.43.D10.1.454.CMB.2.raw
  modified_base (164)..(164): a, c, t, g, unknown or other
  modified_base (339)..(339): a, c, t, g, unknown or other
  modified_base (357)..(357): a, c, t, g, unknown or other
  modified_base (393)..(393): a, c, t, g, unknown or other
  modified_base (404)..(404): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtcgtccccaggagggacagtcactctcacctgtgcttccagcacgtggagcagtcaacctagttacggttaactataccaaacgttcggttaccagacaagaaacctggaacaaacgccacccgaggaccactagtaatttataagtaacaaacaacagacactccncgacccctgacccgttcncacgcctccgtcgtccgggaccaagctcgcctgacncgtgtcaggtngcgagctgaggacgagcgtgagttactacgtacgcctgccttcttagttgtgggtcgggtccgttgggtcgggtcggacgggacggtacgagtcgtacgtaccgtcgtacggtcgacgaccgacggccgtaccgccccgtcggtacctccgtccgttcccgtccccgtaccctcccgaccgaccgtacgccgg

SEQ ID NO: 415802 - DNA, 564 bp, Homo sapiens
  misc_feature: GZ8MTXP02HSLQ5.8.43.D10.1.454.CMB.2.raw
  modified_base (222)..(222): a, c, t, g, unknown or other
  modified_base (286)..(286): a, c, t, g, unknown or other
  modified_base (330)..(330): a, c, t, g, unknown or other
  modified_base (468)..(468): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtgcttccagcacgtggancagtcaccgtagtgttactataccaactgtccagcaagaactggacagcaccagcactgattanagtaacaaacaacagacactccgtacgacccctgtcccggttcncgacggcctcccgtcgtcggggaccaaacgtctacgccctagactactcgtcaggtgtcgcagtccagacgacggagctgagttatacgtcgctgccttatagttagtcgggttggttcgttgggttcggttcggggnggaacgggacaagcgcggtaccgtcgaggtccacgacccgagcccgttcgccccgtcgtcctacgtcgtccgttcccgccgtcctccgacgcgccg

SEQ ID NO: 415803 - DNA, 537 bp, Homo sapiens
  misc_feature: GZ8MTXP02GDCAM.8.43.D10.1.454.CMB.2.raw
  modified_base (292)..(292): a, c, t, g, unknown or other
  modified_base (307)..(307): a, c, t, g, unknown or other
  modified_base (467)..(467): a, c, t, g, unknown or other
  modified_base (476)..(476): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccgagtggttactatccaaactcggttccagcagaaacctggacaagcaccgagccactgatttanagtaacaaacaacanacactctcgacccctgcccgtctcgagcctccctcgttcgggaccaaacgctcgccctcgactctcgtcaggtctgcgagcctgagcgagctagagtatcgtgcgttgactctagttgtcgggtggtcgttagggttcggtcggcggtaggaccaggtcncgacgtcgngtcacgaccagctaccgccccgagtccacgtcgtccgtcccgccgtaccgcaccgtacgcg

SEQ ID NO: 415804 - DNA, 700 bp, Homo sapiens
  misc_feature: GZ8MTXP02HHDE8.8.43.D10.1.454.CMB.2.raw
  modified_base (164)..(164): a, c, t, g, unknown or other
  modified_base (229)..(229): a, c, t, g, unknown or other
  modified_base (262)..(262): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtcgtcccaggaggacagtcactctcacctgtcgcttccagcactggacgcagtcacngtgttactataccaatgttccagcaagtaaccngacagcacagcactgatagatacaaacaacagacactcctcgacccctgcccgttctcgacggcctacccgttcgttccggggaccaaacgtccgcgtaccctacggacctacgttcggtactacgggtgttcggacacgtcccgagacgggaccggtaagccggtagaaggttacttaacgtcgtaccgttcgacctttcgtaaagtttagggttcggggtacgggtttccgggtttaaggggttcggggtttaccgggcggggttaacgggaacccgtaaggcggttaccggtaaacccggttcgtaaacgggttccaccggaccccggttaaacggcccgttcccggtcccccggttaaccggtcctacccgttcccggttacccgttcccccgttaccccttaacccgtcccggaaacccgaccggtacccggg

SEQ ID NO: 415805 - DNA, 631 bp, Homo sapiens
  misc_feature: GZ8MTXP02F3L1G.8.43.D10.1.454.CMB.2.raw
  modified_base (291)..(291): a, c, t, g, unknown or other
  modified_base (330)..(330): a, c, t, g, unknown or other
  modified_base (367)..(367): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtggttactataccaaactggtccagcagaaacctggacaagcacccgagccactgatttanagtaacaaacacagacactccgcgacccctgcccgttcncacgcctcccgtcgtccggaccaagctcgccctgacncgtgcgtaggtcgtgacacggtcctaggaggtaccggaggtctaggtaagttacttacgtggtacctgtaccttattaagtttcggtggggttcggggttccgtttgggggttacgggttccggggacggggacgggacctaaggccgttacggacccgtcgtacggtcgaccggtacccgacgggtccctcccggtcccccgttacggtcccttaccgtcccgtttcccgtcccccgtccctcccgtacgaccgtacggccgg

SEQ ID NO: 415806 - DNA, 573 bp, Homo sapiens
  misc_feature: GZ8MTXP02FSI19.8.43.D10.1.454.CMB.2.raw
  modified_base (287)..(287): a, c, t, g, unknown or other
  modified_base (328)..(328): a, c, t, g, unknown or other
  modified_base (365)..(365): a, c, t, g, unknown or other
  modified_base (375)..(375): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccagccactgattanagtacaaacaacagacactcctcggacccctgcccggttcncacgcctaccctccgtgggaccaaagctcgcctgacnctgcaggtgngcagcctagaggacgaggctagaagttacttacgtcgtaccctgcctcttagttagtgggtacgggttccgtttggggttcggttcgggacggagggtaccagtcgtcgaccgtccgacgtacgacgaccgaacgctccgcccccgtacggtcccacgtccgttcccgttccccacccgtcctaccgacctacggacg

SEQ ID NO: 415807 - DNA, 522 bp, Homo sapiens
  misc_feature: GZ8MTXP02I0F50.8.43.D10.1.454.CMB.2.raw
  modified_base (311)..(311): a, c, t, g, unknown or other
  modified_base (359)..(359): a, c, t, g, unknown or other
  modified_base (437)..(437): a, c, t, g, unknown or other
  modified_base (477)..(477): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaatggtccagcagaaacctggacaagcacccaggccactgattatagtaacaaacaaacagaacactccncgacccctgcccgtctcagctcctccgtgggccaaagctcgcctgacnctgtcgagtgtgcagccgtgaggacgaggctgagtatactgcctgctctattacgtggtcggtcgttgggtgttcggnggaggacgagcgtgacgtcgtacggtcacgccgaacggcnccgtcccctacggtcactcgtcgtcccaccctcgtccgacacgcg

SEQ ID NO: 415808 - DNA, 533 bp, Homo sapiens
  misc_feature: GZ8MTXP02IP329.8.43.D10.1.454.CMB.2.raw
  modified_base (291)..(291): a, c, t, g, unknown or other
  modified_base (333)..(333): a, c, t, g, unknown or other
  modified_base (369)..(369): a, c, t, g, unknown or other
  modified_base (416)..(416): a, c, t, g, unknown or other
  modified_base (440)..(440): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagcccctcactgactgtgtccccaggagggacagtcactctcacctgtgcttccagcactggagcagtcaccagtggttactatccaaactggttccagcagaaacctggacaagcacccaggccactgattanagtaacaaaacaacagacactcctggaccccctgcccgttcncagcctcctcgttcggggaccaaagctgccctgacntgcaggtcgtgcagcctgaggacgagctagagtatactgcctgcctntatgtggtggtcgttggtgtcggnggaggactagagcgtcgacgtcgtacgcgacgaccgacgcctccgtccccgtcgtcctaacgtccttccgtccccacctccgtacgaccgacg

SEQ ID NO: 415809 - DNA, 666 bp, Homo sapiens
  misc_feature: GZ8MTXP02FLMVM.8.43.D10.1.454.CMB.2.raw
  modified_base (219)..(219): a, c, t, g, unknown or other
  modified_base (285)..(285): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcagcactggancagtcaccagtgttactatccaaatggttccagcagaaacctggacaagcaccaggccatgattanagtaacaaacaacagacactccgtcggacccctagcccggttctcacggcctcccctcgtcggggaccaaagctacgcctagactacgtcgtacaggttagtcgtacgacgtccctaggacggaacggtacgggctaggtaacgttacttaaccgtgtaccgtcgtaccttacgtttaagttaggttcggggttcggggtcccgttttagggggtcgggtttccgggggaccgggtaagggggaaacccgtacggttaccgtacggtaacccgtacggttaacggtacgaaccggaccctaaaggggccctaccggtacccccggtcggtcctaccgtccgttccggttccccgtcccgtcccgtaccggacgacgtccgg

SEQ ID NO: 415810 - DNA, 679 bp, Homo sapiens
  misc_feature: GZ8MTXP02GAIXJ.8.43.D10.1.454.CMB.2.raw
  modified_base (283)..(283): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcaccagtgttactatccaaatggtccagcagaacctgacaagcaccagccatgatttanagtaacaaacaacagacactccgcgacccctgcccgttctcacggcctccctccgttcggggacccaaagctacgccccgtagacctacgtgtccaggggttcgtcgacgcgtcccgtagacgggaaccgagggctagaagttacttaccgtgtccctgcctttactaagttagtggggttcgggttccgggtttgggtcgggttaccgggaccgggacggggtaacccgaaaggtccgtacggtacccggttaccgtaacgggtaccgaaccggtacccggtaaacggtcccgttccccgggtacccccgttccgggttaccctaaacccgttcccgttaccccgttacccccgtacccccttcccggttaacccgaaccgtaccccggtaccgg

SEQ ID NO: 415811 - DNA, 579 bp, Homo sapiens
  misc_feature: GZ8MTXP02H2JRD.8.43.D10.1.454.CMB.2.raw
  modified_base (288)..(288): a, c, t, g, unknown or other
tcagctcgcgtgtccacgaccggtgctcgatttagactagcagtaagggggcgccaggggtcccttccaatatcagcaccatggcctggactcctctcttttctgttcctcctcacttgctgcccagggtccaattctcagactgtggtgactcaggagccctcactgactgtgtccccaggagggacagtcactctcacctgtgcttccagcactggagcagtcaccagtggttactatccaaactgttccagcagaacctggacaagcacccaggccactgattanagtaacaaacaacagaccactcctcggacccctgccccggttctcacggcctccctccgttcggggccaaagctcgccctgactcgtcgtcaggtgtcgcgacgccgtagacgacggagcgtagagttacttacgtgtcctcgtctactattagtgggtacgggttcgtttgggtcgggttcgggcggacgggacgtaggcgtacggacccgtcgtacggtcgacgtccgaacgtcgccgtccccgtcgtacctctccgtcgtcccctacccgtccgtaccgaccacgccg

SEQ ID NO: 415812 - DNA, 593 bp, Homo sapiens
  misc_feature: GZ8MTXP02IE45O.8.43.D10.1.454.CMB.2.raw
  modified_base (218)..(218): a, c, t, g, unknown or other
  modified_base (331)..(331): a, c, t, g, unknown or other
  modified_base (372)..(372): a, c, t, g, unknown or other
  modified_base (525)..(525): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttcagcactggancagtcaccagtgttactataccaaactggttccagcaagaaactggacaagcacccagccactgtattaatagtaacaaacaacatacacctctcggacccctgtcccgttcncgacggtcctcccgtcgtccgggaccaacgctcgcctgacncgtgcaggtcgtgcagccgtaggaggacgaggctagagttactacgtcgccttgactgtacgttagtcggtacgggttcgttggggttggttcgggcgggaaggtaccaaggtcgtacgtaccgtcgtacgtaccgaccggccgaacgttccncccggacccccgtacgttccaccgtccgttacccgtcccctaccccgtcctaccgaccgaacggccgg

SEQ ID NO: 415813 - DNA, 536 bp, Homo sapiens
  misc_feature: GZ8MTXP02HMWGH.8.43.D10.1.454.CMB.2.raw
  modified_base (228)..(228): a, c, t, g, unknown or other
  modified_base (361)..(361): a, c, t, g, unknown or other
  modified_base (373)..(373): a, c, t, g, unknown or other
  modified_base (404)..(404): a, c, t, g, unknown or other
  modified_base (444)..(444): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccngtggttactatccaaactggttccagcagaacctggacaagcacccagccactgattatagtacaaacaacagacactcctggacccctgcccgtctcaggcctccctcttggggccaaagctgaccctgacnctgtcagtcgtncagccctagacggacgaggctagagtatacngcctgctctattagtggtgggtccgttgggtgttccgggnggaggaccaagcgtgacccgtcgtaggtcacgccgaaacggcctcgtcccctacgtcactccgtcgttccccacctcctccgaccacggccg

SEQ ID NO: 415814 - DNA, 578 bp, Homo sapiens
  misc_feature: GZ8MTXP02JF9RX.8.43.D10.1.454.CMB.2.raw
  modified_base (368)..(368): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgttactatccaaactggtccagcagaaacctggacaagcacccaggccactgattatagtaacaaacaacagacactcctcggacccctgcccggttctcgaggcctccctcttcggggccaagctagcccctgacnctgtcaggtcgtgctagccctagaggacgaggctgagtatactgccctgctctattagtggtcggtccgttgggtggttcgggtcggaggaccgagcgtacgaccgtacgtacggtcgtacgacccgtaacggccgtcggcccccgtcgggtcctaccgttccgttccggttccccctaccccgttccctaccgtaccgaaccggcccgg

SEQ ID NO: 415815 - DNA, 651 bp, Homo sapiens
  misc_feature: GZ8MTXP02G4ESV.8.43.D10.1.454.CMB.2.raw
  modified_base (223)..(223): a, c, t, g, unknown or other
  modified_base (277)..(277): a, c, t, g, unknown or other
  modified_base (298)..(298): a, c, t, g, unknown or other
  modified_base (343)..(343): a, c, t, g, unknown or other
  modified_base (371)..(371): a, c, t, g, unknown or other
  modified_base (380)..(380): a, c, t, g, unknown or other
  modified_base (392)..(392): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttccagcactggancagtcactagtggttactataccaaactggttaccagcaagaaacctggaacanccacccaggccactgatttanagtaacaaacaacagacctactccgtcggacccctgtcccgttcncgacgtcctcctcgtccggaccaagtcncgcctgacncgtgtcgaggtntgcacgtccgtaggacggtaccgagcgtaggtagttaacgttacgtcgtcccgttagtaccgttactttaagttcgggtttcgggttcggggttcccggtttaggggttcgggttccggggtacgggacggtaaccgaacggtcgtaccggtaccgtcgttaggaccgaccggaccgaaccgtcccgtcccggtccccgtccggtacctccgttccgtacccgttccccgtacccgtcccgtaccgtaccgcgtaccgg

SEQ ID NO: 415816 - DNA, 614 bp, Homo sapiens
  misc_feature: GZ8MTXP02FVNO8.8.43.D10.1.454.CMB.2.raw
  modified_base (290)..(290): a, c, t, g, unknown or other
  modified_base (383)..(383): a, c, t, g, unknown or other
  modified_base (411)..(411): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactataccaaactggttccagcagaaacctggacaagccaccaggccactgattanaagtaacaaaacaacagacactccgtacgacccctcgtacccggttctcgacggcctccccgtcgtaccggggacccaaagctacgcctgacnctgcgaggtgtgcagccgtagaggacgngcgtagtagtactacgtcgtacctgtctacttagttaggtgggtcggggtcgttggggtcgggttacgggacgggtacgggaacctaggtcgtacggtacccgtcgtacggtacgacgaccgaacggtcccgtaccggtcccccgtcggtacctacccgttccgttcccgtccccggtccctcccgtacgaccgaccggaccg

SEQ ID NO: 415817 - DNA, 627 bp, Homo sapiens
  misc_feature: GZ8MTXP02F5NUY.8.43.D10.1.454.CMB.2.raw
  modified_base (289)..(289): a, c, t, g, unknown or other
  modified_base (373)..(373): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtaacaaacaacacgacacctcctcggacccctgcccggttctcagcctcccctccgttcggggaccaaagctcgccctgacnctgtcgaggtgtcgcagccctggacggacgaggctaggtagtacttacgtcgtccgtgcttcttagttaggtcgggttcggggtccgtttggggttcgggtttcgggacggggtacgggaccgaaggtcgtacggacccgtccgtacggtaccgacgtacccgaaacgggtccgtaccggtccccccgttcgggtccctaccgtccgttcccggttcccccgtccccgtacccgtcccggaaccgaccggccgg

SEQ ID NO: 415818 - DNA, 531 bp, Homo sapiens
  misc_feature: GZ8MTXP02G01GP.8.43.D10.1.454.CMB.2.raw
  modified_base (256)..(256): a, c, t, g, unknown or other
  modified_base (279)..(279): a, c, t, g, unknown or other
  modified_base (357)..(357): a, c, t, g, unknown or other
  modified_base (402)..(402): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggaggacagtcactctcacctgtgcttccagcactggagcagtcacagtgttactatccaaactgtccagcagaacngacaagcaccagccactgattanagtacaaacaacagacactctcggacccctgcccggttctcagtcctccctcgtcggggaccaaagctacgcctgacnctgtcaggtgtgcagcctgacgacgagctgagtatactgctgctntacttagtggtcggtcgttgggtggttcggcggtaggacgaacgcgtacgaccgtcgtaggtcacgaccgaacggctccgccccgtcgtccgactccgtcgtccccaccgtccctacgaccgacgaccg

SEQ ID NO: 415819 - DNA, 551 bp, Homo sapiens
  misc_feature: GZ8MTXP02HCE9C.8.43.D10.1.454.CMB.2.raw
  modified_base (165)..(165): a, c, t, g, unknown or other
  modified_base (198)..(198): a, c, t, g, unknown or other
  modified_base (207)..(207): a, c, t, g, unknown or other
  modified_base (244)..(244): a, c, t, g, unknown or other
  modified_base (266)..(266): a, c, t, g, unknown or other
  modified_base (284)..(284): a, c, t, g, unknown or other
  modified_base (290)..(290): a, c, t, g, unknown or other
  modified_base (295)..(295): a, c, t, g, unknown or other
  modified_base (306)..(306): a, c, t, g, unknown or other
  modified_base (308)..(308): a, c, t, g, unknown or other
  modified_base (326)..(326): a, c, t, g, unknown or other
  modified_base (334)..(334): a, c, t, g, unknown or other
  modified_base (337)..(337): a, c, t, g, unknown or other
  modified_base (342)..(342): a, c, t, g, unknown or other
  modified_base (346)..(346): a, c, t, g, unknown or other
  modified_base (364)..(364): a, c, t, g, unknown or other
  modified_base (376)..(376): a, c, t, g, unknown or other
  modified_base (383)..(383): a, c, t, g, unknown or other
  modified_base (386)..(386): a, c, t, g, unknown or other
  modified_base (401)..(401): a, c, t, g, unknown or other
  modified_base (403)..(403): a, c, t, g, unknown or other
  modified_base (426)..(426): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgaactcaggagccctnactgactgtgtccccaggagggacagtcactcncgacctgtncttaccagcactgggatcagtcaccgagtggttactntacccgaaattggtccagctanaaacctggacaagcaccnggcctntgatntaaggacaaananaggacacgtccaagcccngccggttnacngtccncctntaccggggccaagttccncgactcactcgngtcgagngcncacgcgagacgacgngngtagtagtagtctcgtctctctntagttgtggtcggtcgttgggtcggtcggacggacggacgacgcgtacgtacgtacgtacgtacgacgacgacgcgtccgtcccgtcgtctccgtccgtcctccctacctccgaccgacgacgcg

SEQ ID NO: 415820 - DNA, 637 bp, Homo sapiens
  misc_feature: GZ8MTXP02HOZ4B.8.43.D10.1.454.CMB.2.raw
  modified_base (297)..(297): a, c, t, g, unknown or other
  modified_base (347)..(347): a, c, t, g, unknown or other
  modified_base (407)..(407): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccgaggagggacagtcactctcacctgtgcttcagcacgtggagcagtcactagtgttacataccaactgttacagacaacgaactggaacaacgccaacccgagaccacgtgtatttaanagtaacaaaacaacagaaccactaccgtccggacccctagtcccggttcncgaccggtcctcccgtcgtccggggacaaacgctacgcctgactctacgctaggtcgacnctacgccgtagaggacgaggcgtagacgttaattccgtggcctgtaccttacgttaaattggttgggtcggggtttccgggttggggttcgggttacgggacggggaaccggtacgaacggttcgacggtacccgttaccggaacggtcaccggaccgaacggccctccggccccgtcgtacgttcgtcccgttccggtaccccctaccctccgccggacaccggtacgg

SEQ ID NO: 415821 - DNA, 685 bp, Homo sapiens
  misc_feature: GZ8MTXP02IIHTR.8.43.D10.1.454.CMB.2.raw
  modified_base (309)..(309): a, c, t, g, unknown or other
  modified_base (350)..(350): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgcttccagcacgtggagcagtcaccgtagttggttaactatacctaaacgtcggttccagcaagaaacctggaacaacgcacccgaggcccactgtatttanagtaacaaacaacagacactcctcggacccctgcccgttcncagtcctcccgtcgtcgggaccaaagctcgcctgactctcgtctagggtgtcgactacgcccgtggacgggaacggtacggcgtaggaagttacttaacgtcgtccgttgacccttacgttaaagttaggttgggggttcggggttccggtttgggggttcgggtttcggggacggggaacggggaacgaacggtcggtaccggacccggttaccgtacggtaccgaccggacccggtaaacgggtccctaccccgggtcccccgttccggtcccgtaccgttcccgttcccggttcccccgtcccctcccggtacccgaaccgccggacccggg

SEQ ID NO: 415822 - DNA, 599 bp, Homo sapiens
  misc_feature: GZ8MTXP02GYUQP.8.43.D10.1.454.CMB.2.raw
  modified_base (221)..(221): a, c, t, g, unknown or other
  modified_base (253)..(253): a, c, t, g, unknown or other
  modified_base (257)..(257): a, c, t, g, unknown or other
  modified_base (266)..(266): a, c, t, g, unknown or other
  modified_base (272)..(272): a, c, t, g, unknown or other
  modified_base (276)..(276): a, c, t, g, unknown or other
  modified_base (278)..(278): a, c, t, g, unknown or other
  modified_base (285)..(285): a, c, t, g, unknown or other
  modified_base (287)..(287): a, c, t, g, unknown or other
  modified_base (290)..(290): a, c, t, g, unknown or other
  modified_base (292)..(292): a, c, t, g, unknown or other
  modified_base (310)..(310): a, c, t, g, unknown or other
  modified_base (312)..(312): a, c, t, g, unknown or other
  modified_base (358)..(358): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggacgccctcactgactgtcgtcccaggaggacagtcactctcacctgtcgtcttccagcactggancagtcactagtgtactatacaactgtcagcanaacngacagcacngcatanatananacaacananacncnctcgaccctcgtccgtcncncgcctccgtcgtcggacaagctacgcctgactcgtcgtacgaggtntcgacgacgccgtagacggtacgaagtcgtagtaacgttaacgttcgtcgtccgtacgtacttacgttaaggtttacggttggggttcggttcggttcgggggttacgggtacgggacgggtacggaccgtaagtcgtaccgtaccgtcgtacgtaccgccggaacctacggccgtccccgtacccgtccggtcctccgtcccgttccggtacccccgccctccgaccaaccggcgtccgg

SEQ ID NO: 415823 - DNA, 732 bp, Homo sapiens
  misc_feature: GZ8MTXP02HBW4Z.8.43.D10.1.454.CMB.2.raw
  modified_base (259)..(259): a, c, t, g, unknown or other
  modified_base (280)..(280): a, c, t, g, unknown or other
  modified_base (295)..(295): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtcgcttccagcacgtggagcagtcacagtgtactatcaactggtccagcagaacngacagcaccagccatgattanagtaacaaacaacanacactccgtacggacccctgacccggttctacgacggtcctacccgtcggtaccggggacctaaagccgtacgccctagactcgtcgtcgacggttcgagcacgtcccgtagacggaccgaaggtcgtaaggtaacgttactttacgcgtaacccgtgtacccttacgttaaacgtttagggttcggggtttccgggtttcgggttacgggggtttccgggttaccgggggacggggtaaccggggaacccgtaaggttcccgtaccgggtacccggtttacggtaacgggttaccggaaacccggtcccggaaaacgggtcccgttaccccggtccccccggttaacggtcccgttaaccggttcccgttaacccccggtttccccctacccccgtttaccggtaccccggtaaacccgtaaccgggtaccccggg

SEQ ID NO: 415824 - DNA, 610 bp, Homo sapiens
  misc_feature: GZ8MTXP02I6YVE.8.43.D10.1.454.CMB.2.raw
  modified_base (290)..(290): a, c, t, g, unknown or other
  modified_base (329)..(329): a, c, t, g, unknown or other
  modified_base (366)..(366): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtaacaaacaacagacactcctggacccctgcccgttntccgagcctcctccgtcggggccaagctcgcctgacnctgcaggtgtgctagcccgtggacgggacgaggctaggtagttattaccgtgcctgcttacttattaggtgggttcgggtccgtttgggggtcggtttacggggaccgggacgggacgaacggtcgtcggtacccgtcgtaacggtccacggtacccgaagggtccctcccggcccccgttcgggtaccctaccgttccgttcccgttccccgtcccctaccgtaccggaccgaaccggtccgg

SEQ ID NO: 415825 - DNA, 629 bp, Homo sapiens
  misc_feature: GZ8MTXP02JDYBX.8.43.D10.1.454.CMB.2.raw
  modified_base (285)..(285): a, c, t, g, unknown or other
  modified_base (325)..(325): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccgaggagggacagtcactctcacctgtgcttccagcacgtggagcagtcaccagtgttactatccaaatgttccagcaagaactgacaagcaccagccactgtattanagtaacaaacacagacactcctcgacccctgtcccgttcncgacgcctcccgtcgtcgggaccaagcctcgccctgacctcgtgtacgaggtgtcgacgacgcgtaggacggtacggaggtcgtagtaagttacttacgtcgtccctagtcttacgttaagtttgtcggggttcgggttccggtttggggttcgggttcgggacgggggacggaaccgaggtccgtacggtaccgtcgtacggtaccgtaccggaccgaacgggtcctcccggtcccccgttacggtcccttaccgtccgttcccggttcccccgtccccgtccgtacccgaccgtaccgccgg

SEQ ID NO: 415826 - DNA, 543 bp, Homo sapiens
  misc_feature: GZ8MTXP02JOKOM.8.43.D10.1.454.CMB.2.raw
  modified_base (219)..(219): a, c, t, g, unknown or other
  modified_base (288)..(288): a, c, t, g, unknown or other
  modified_base (335)..(335): a, c, t, g, unknown or other
  modified_base (382)..(382): a, c, t, g, unknown or other
  modified_base (386)..(386): a, c, t, g, unknown or other
  modified_base (395)..(395): a, c, t, g, unknown or other
  modified_base (416)..(416): a, c, t, g, unknown or other
  modified_base (429)..(429): a, c, t, g, unknown or other
  modified_base (461)..(461): a, c, t, g, unknown or other
  modified_base (472)..(472): a, c, t, g, unknown or other
  modified_base (477)..(477): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgttactataccaaatggtccagcagaaacctggacaagccaccgagtccactgatttanagtaacaaactaacagaacactccgtacggaccccttggacccgttnccgacggtcctccccgtcgtacggggaccaacgtctacgcctagacncgtnacgtgggtntcgacgcgccgtgacggacgngacgtgagtatcngcctgctctatgtggtgtcgtgggtgtacggngaggacagcgngtacncgtagtcacgccgacgctccgcccgtcgtactccgtctccgttacccacctccgtacgccgacgcg

SEQ ID NO: 415827 - DNA, 560 bp, Homo sapiens
  misc_feature: GZ8MTXP02I17PH.8.43.D10.1.454.CMB.2.raw
  modified_base (221)..(221): a, c, t, g, unknown or other
  modified_base (281)..(281): a, c, t, g, unknown or other
  modified_base (293)..(293): a, c, t, g, unknown or other
  modified_base (322)..(322): a, c, t, g, unknown or other
  modified_base (362)..(362): a, c, t, g, unknown or other
  modified_base (372)..(372): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggancagtcaccagtgttacatcaaactggtccagcagaactggacagcaccagccatgattanagtaacaacaanagacactcgtcgacccctgacccggttcncgacgtcctccgtcgtcggggaccaagcctcgcctagacnctgcgaggtngtcacgtcgtagaggacgagctagtagtcttactgtctcgtctcgttacttgttgggtcggttcgttggggttcggttccgggcggacgggacacggtcgtacgtccgtcgtacgcgacgaccgaacggtctaccggccccgtacggtccaccgtcgttccgtacccgcctccgaccgtcgccgacgg

SEQ ID NO: 415828 - DNA, 580 bp, Homo sapiens
  misc_feature: GZ8MTXP02JTM5C.8.43.D10.1.454.CMB.2.raw
  modified_base (288)..(288): a, c, t, g, unknown or other
  modified_base (367)..(367): a, c, t, g, unknown or other
  modified_base (411)..(411): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctgacaagcaccaggccactgatttanagtaacaaacaacagacactcctcggacccctgcccggttctcacgcctccctccgtggggccaaagctcgccctgacnctgtcagggtgtgcagcccgtgacggacgaggctgagtattacngcctgctctattagtgggtcgggtcgtttgggttgggttcgggcggacgggaaccgagcgtcgtaccgtcgtaggtccgacgtcccgaacggtcctccgtcccccgtccggtacctaccgttccgttcccggttacccccaccccgtccccgtacgacccgacgacccg

SEQ ID NO: 415829 - DNA, 728 bp, Homo sapiens
  misc_feature: GZ8MTXP02GZHEV.8.43.D10.1.454.CMB.2.raw
  modified_base (197)..(197): a, c, t, g, unknown or other
  modified_base (221)..(221): a, c, t, g, unknown or other
  modified_base (370)..(370): a, c, t, g, unknown or other
  modified_base (418)..(418): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtcccaggagggacagtcactcncacctgtgcttccagcacgtggancagtcaccgtagttcggttaactactaccaaacgtcggttacccaggcaaacgaaaccgtggaacaacgccaacccacggccacgtagtatttaacaacgtaacaaaacaacacgaacctacctccgtaccggacccctcggtcccgtntccgacgtcctcccgtcgtaccgggaccaagtcctaccgcctagaccncgttcgtacgagggtgtcgacgacgtccgagggaacggtacggacgtcgtagtaaacgttacttaccgcggtccttaggtccttaacgtttaaagtttacgggtcgggggttacggtttccgggtttacggggttcgggggttaaccgggacggggaaccgggtaaaccgtaacgggtccgtaccggtacccggtttacggaccgggttaccgaccggttacccggacgggtcccttcccggtcccccggtcgtaacccgtcttcccgttacccggttaccccccgccgtaccgaccggaccgaccgtcg

SEQ ID NO: 415830 - DNA, 668 bp, Homo sapiens
  misc_feature: GZ8MTXP02I2YBX.8.43.D10.1.454.CMB.2.raw
  modified_base (164)..(164): a, c, t, g, unknown or other
  modified_base (277)..(277): a, c, t, g, unknown or other
  modified_base (305)..(305): a, c, t, g, unknown or other
  modified_base (353)..(353): a, c, t, g, unknown or other
  modified_base (401)..(401): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtcgtcccgaggagggacagtcactctcacctgtcgcttccagcacgtggagcagtccaccgtagtggttactatacctaaacgttcggtccaagcaagtaaaccnggacaagccaccaggccactgtatttanaagtaacaaacaacagaccactccgtacggacccctggtccccgttcncacggtcctccccgtcgttcggggacccaaagtcctcgccctagaccncgtgtacctagggtcgtcgacacggccgtaggacggacggaagccgtaggtaacgttacttaccggtcgtccctagggtccttacgttaaagttcggttggggtcgggttaccgggtttggggttacgggttcgggacggggaaccgggtacgtaacgcgtccggtaccgtacgacggtaccgaccgtacccgacgggtcctcccgtccccgttacggtcctacccgttccgtcccgtccccgtccctcgtccgaacccgcgtccgg

SEQ ID NO: 415831 - DNA, 657 bp, Homo sapiens
  misc_feature: GZ8MTXP02IOU7N.8.43.D10.1.454.CMB.2.raw
  modified_base (164)..(164): a, c, t, g, unknown or other
  modified_base (248)..(248): a, c, t, g, unknown or other
  modified_base (255)..(255): a, c, t, g, unknown or other
  modified_base (260)..(260): a, c, t, g, unknown or other
  modified_base (275)..(275): a, c, t, g, unknown or other
  modified_base (314)..(314): a, c, t, g, unknown or other
  modified_base (351)..(351): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtgtcccaggagggacagtcactctcacctgtgcttccagcactggagcagtcaccagtgttactatcaactgtcancagaacngacancacagcactgattanagtacaaacaacagacactcacgacccctcgcccgttcncacgcctcctcgtcgggaccaagcctcgccctgaccncgtcgcgtagggtcgtcgcacgtccgtggacggacggcgacgtagtaagttacgttaccgtacgtctcgacttacgttaagtttacggttcgggttcgggggttccggtttcgggggttcgggtttccgggggaccggggtaacgggtaccggaacggtcgttacggtaacccggtccggttacgggtaccgaccgggacccgtaacgggtccgtccccggtcccccgttaccgggttacctacccggtttccgtcccccggtttccccgtcccccgttccgtacccggaccctacggggtacccg

SEQ ID NO: 415832 - DNA, 695 bp, Homo sapiens
  misc_feature: GZ8MTXP02GWKZC.8.43.D10.1.454.CMB.2.raw
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcacgtggagcagtcacctagttgttactataccaactggtccagcaagaaacctggaacaagccaaccgaggaccactagtaatttaataacgtaacaaaacaaacacgaacctacctaccgtaccggtacccctcgtccccggttctccgaccggtcccttaccccggttccgttacccggggacccaaacggtcctccgccccttaggacctacgttcgtcgacgggtgtcgacgacgtccgtaggcggaacggaggacgtagtaacgttacgttaccgtcgtacctcggtccttacgttagttaggttcgggtcgggttccggttggggttacgggttccggggaacgggtacgggtaaccgaacggtcgtaccggtaccggtacgttacggtaccgaccggtaccgtaaccggtccgtaccggtccccgtacggtcctacgtccgtccgttccccgccctccgtaccgaccaccggccgg

SEQ ID NO: 415833 - DNA, 755 bp, Homo sapiens
  misc_feature: GZ8MTXP02INCRJ.8.43.D10.1.454.CMB.2.raw
  modified_base (733)..(733): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcgaggacgccctcactgactgtcgtccccgagggagggacagtcactctcacctgtcgtccttccagcacgtggagcacgtacaccgtagttacggttaactacgtacctaaacgtcgttaccaggacaacgaaaccgtggaccaacgccaccgaacgccaactgtaatttaatacgtaacaaaacaacaagacctacctaccgtaccggacccctcggtaccccgtttctaccgaccggtccctccccgtcggttacccgggacccctaaagtcctcgccctacgaacctcgtgtcgtaggtgtacgcgaacgcgtagggacggacgagggcctaggtaacgttattaccgtcgaccgttctaccgtttagtttacggttaggttcggggtttggggttccggtttaggggttcggggttaccggggaggggtaaccggtaaccgacggggttccgtaccgggtaccccggttacggtaccgggtacgacccccgggtccgtaaccggtcccggtaccccggttccccggttacccgtccttacccgtcccgtttccccgtcccccggttaacccccnccgtacccggaccgtccggacg

SEQ ID NO: 415834 - DNA, 680 bp, Homo sapiens
  misc_feature: GZ8MTXP02IAUAC.8.43.D10.1.454.CMB.2.raw
  modified_base (300)..(300): a, c, t, g, unknown or other
  modified_base (396)..(396): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacctaggtcggttaactatacccaaacgttggttaccagcaacgaaacctggacaagccaccaggccactgattanagtaacaaacacagacacgtctcgacccctcgtcccggttctcgacggtcctcccgtcgttccggggacctaaacggtcctacgcccttaggaccncgttagtccgagggttcgtacggcacgtccgtgacggacgaggcgtagaacgttacttacgtcgtcccgtgtcctcgttaatttaggtcgggttcgggttcccggtttaggggttcggttacggggtccgggtaacggtaccgaaacggtcgtcggtaccgtaccgtacggtcgacggtacccgaacggtccgtacccggtcccccgtccggtacctaccgttcccgttacccgggtttccccccgtaccccgttacccgtacccgtaaccgtacccggaccgg

SEQ ID NO: 415835 - DNA, 518 bp, Homo sapiens
  misc_feature: GZ8MTXP02HZ8GN.8.43.D10.1.454.CMB.2.raw
  modified_base (163)..(163): a, c, t, g, unknown or other
  modified_base (244)..(244): a, c, t, g, unknown or other
  modified_base (251)..(251): a, c, t, g, unknown or other
  modified_base (256)..(256): a, c, t, g, unknown or other
  modified_base (259)..(259): a, c, t, g, unknown or other
  modified_base (261)..(261): a, c, t, g, unknown or other
  modified_base (269)..(269): a, c, t, g, unknown or other
  modified_base (274)..(274): a, c, t, g, unknown or other
  modified_base (286)..(286): a, c, t, g, unknown or other
  modified_base (292)..(292): a, c, t, g, unknown or other
  modified_base (307)..(307): a, c, t, g, unknown or other
  modified_base (320)..(320): a, c, t, g, unknown or other
  modified_base (332)..(332): a, c, t, g, unknown or other
  modified_base (340)..(340): a, c, t, g, unknown or other
  modified_base (345)..(345): a, c, t, g, unknown or other
  modified_base (347)..(347): a, c, t, g, unknown or other
  modified_base (351)..(351): a, c, t, g, unknown or other
  modified_base (354)..(354): a, c, t, g, unknown or other
  modified_base (369)..(369): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctnactgactgtgtccccaggagggacagtcactctcacctgtgctaccagcactggacgtcagtcacagtgttacatccaaangtccagnagacnganancacagcangatanagtacaaacaanagacanctgacctgtccgtcncacgcctccgtcnccgggtacaaancagtcccngaccntncagngtncagccagagacgagngagtatagtactgctagtctatatagtggtggtggtggtcggtcggacggacggacgacgacgcgtacgtacgacgtacgacgaccgacgccgtaccgacccgtccgtcgtcctccgtccgtacccgtccctaccgaccaccgacgacg

SEQ ID NO: 415836 - DNA, 550 bp, Homo sapiens
  misc_feature: GZ8MTXP02JJ1GK.8.43.D10.1.454.CMB.2.raw
  modified_base (268)..(268): a, c, t, g, unknown or other
  modified_base (273)..(273): a, c, t, g, unknown or other
  modified_base (279)..(279): a, c, t, g, unknown or other
  modified_base (319)..(319): a, c, t, g, unknown or other
  modified_base (357)..(357): a, c, t, g, unknown or other
  modified_base (368)..(368): a, c, t, g, unknown or other
  modified_base (396)..(396): a, c, t, g, unknown or other
  modified_base (411)..(411): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtcgcttccagcactggagcagtcaccagtgttactatccaactgtcagcagaactgacagcaccngcacngattanagtacaaacaacagacactcctcggacccctgcccgttcncgacgcctccctcgtcggggccaaagctcgcctcgacncgtgcaggtgngcacgctgagacgagcgtagagtatacngcctgctctattagnggttcggtcgttgggtggttacggcgggtacggacgtacggcgtacggtaccgtacgtacggtaccgacgacccgaacggtctacccgccccgtcggtacctccgtcgtcccgtcccgccctccgtaccgaccgcgccg

SEQ ID NO: 415837 - DNA, 731 bp, Homo sapiens
  misc_feature: GZ8MTXP02F4UIC.8.43.D10.1.454.CMB.2.raw
tcagctcgcgtgtccacgaccggtgctcgatttagactagcagtaagggggggcgccaggggtcccttccaatatcagcaccatggcctggactcctctctttctgttcctcctcacttgctgcccagggtccaattctcagactgtggtgactcaggagccctcactgactgtcgtccccagggagggacagtccactctccacctgtcgtcttccagcacgtggagcagtccaccgtaggttcggttaactactaccaaacgttcggttaccagacaacgaaacctggaacaacgaccacccgaggaccactagtaattaataagtaaacaaacaacaacgactacctccgtaccgacccctcggtacccgttctcgacggtcctcccgtcgtaccgggactaacgctacgccctacgactcgtcgtcgtagggtcgtcgacgtacgcgtacgacggacggacggtcgtaggtaagttacgtacgtcgtccgtcgtacttacgttaagttcggtcggggttcggggttccggtttgggggttcgggttaccggggtaccggggaacgggtaccggtaacggtaccgttccgggtaacccggttccggtaacggtaccggtaaccggacccggtaaacgggtcccttacccgggtacccccggtaccgttcccgttaccgttccgtcccggttccccgtcccgttaccgtccggaaccgtccggaaccgg

SEQ ID NO: 415838 - DNA, 692 bp, Homo sapiens
  misc_feature: GZ8MTXP02JDFGR.8.43.D10.1.454.CMB.2.raw
tcagctcgcgtgtccacgaccggtgctcgatttagactagcagtaagggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcacgtggagcagtcacctagttaggttactatacctaaacgtggttccagcaacgaaacctgacaagccaccgaggccatgattatagtaacaaacaacagacacctcctcggacccctcgtcccgttctcgacgtccctccgtcgtacggggaccaacgctacgccctgacctcgtgtacgtagggtctcgacacgtccgtaggacgggacggacggcgtacgtagttaacttccgtacgccttaggccttagtttagttaggttcgggggtcgggttccgggtttggggttcggggtttaccgggacgggggtaaccggtaacgtacgggtcgttaccgggtacccggttaccgtaacgggggtccctaacgggaccccggtaaacggtccgtaccccggtccccgttcccggtacctaccgttaacccgttcccggtacccccaacccgttcccgtaccgacccggttacggaccg

SEQ ID NO: 415839 - DNA, 644 bp, Homo sapiens
  misc_feature: GZ8MTXP02HJ38K.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcactggagcagtcacctagtggttactatacctaaactggttaccagcaagaaacctggaacaagccaccaggccactagtattatagtaacaaaacaacagaccactccgtacgacccctgtcccggttctcgacgtccctcccgtcgtcggggaccaagcctcgccctgactcgtcgtcgaggtcgtgcgagccgtaggacggacggagcgtagtagttaacgttacgtccgtcgtcgacttcgttaaagtttggttggggtcgggttcgtttggggttcgggttacggggacggtaccgggacgaacggtcgtcggtaccggtcctaaggttccgacgaccggaacggtcccgtacccggcccccgttcggtccctacttccgttcccgttccccgtaacccgtccgtacccgaccgttaccgaccgg

SEQ ID NO: 415840 - DNA, 589 bp, Homo sapiens
  misc_feature: GZ8MTXP02F5UU4.8.43.D10.1.454.CMB.2.raw
  modified_base (290)..(290): a, c, t, g, unknown or other
  modified_base (367)..(367): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcaccaggccactgatttanagtacaaacaacagacactcctggacccctgcccggttctcagcctccctcttcggggcccaaagctcgccctgacnctagtcaggtgtgcagccctgaggcgaggctgagtatactgaccttgctcgtatagttggtgggtccttggggttgttcgggccggtaaggggacccaaaggtcctggtaaccgtcccgtagggtaccaacgccccgaaaggtcctccggtacccccttcggggtcctaaccggttcctacccggttcccctacccccgttccgaccggaaccaccgcccgg

SEQ ID NO: 415841 - DNA, 653 bp, Homo sapiens
  misc_feature: GZ8MTXP02FOXAU.8.43.D10.1.454.CMB.2.raw
  modified_base (253)..(253): a, c, t, g, unknown or other
  modified_base (269)..(269): a, c, t, g, unknown or other
  modified_base (276)..(276): a, c, t, g, unknown or other
  modified_base (298)..(298): a, c, t, g, unknown or other
  modified_base (315)..(315): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcacagtgtactatcaatgtcagcagaacngacaagcaccagcacngtattanagtaacaaacacagacactccncgacccctgcccgttcncacgcctccctcgtcgggaccaaagctcgcctagacctaccgtgtactagggtcgtagacgacgtaccgtacggaacggaccggtaggaccgttaggtaacgtttaaacttaccgtcggtccttcgacttaccgttaagtttaggtcggggtttacgggtcggtttagggggttcgttacggggacgggtaacgggaaccgtagcgtacggacccgttacgtaacggtaccgaccgaccgtaacggccgttacccggcccccttaccgggtaccctaaccgttcccggttcccgttaccccctaaccccgttcccgtaccgaacccgttacccgacgg

SEQ ID NO: 415842 - DNA, 681 bp, Homo sapiens
  misc_feature: GZ8MTXP02GL9NZ.8.43.D10.1.454.CMB.2.raw
  modified_base (224)..(224): a, c, t, g, unknown or other
  modified_base (374)..(374): a, c, t, g, unknown or other
  modified_base (405)..(405): a, c, t, g, unknown or other
  modified_base (423)..(423): a, c, t, g, unknown or other
  modified_base (427)..(427): a, c, t, g, unknown or other
tcagctcgcgtgtccacgaccggtgctcgatttagactagcagtaagggggggcgccaggggtcccttccaatatcagcaccatggcctggactcctctctttctgttcctcctcacttgctgcccagggtccaattctcagactgtggtgactcaggacgccctcactgacctgtcgtcccgaggagggacagtcactctcacctgtgcttcagcacgtggancagtcacctagtaggttaactactaccaaacgttcggttaccagtaccaaacgtaaaccgtggaaccaaacgccaccccgaggaccacgtaggtaactttaagaacgtaaacaaactaacagaccaactccgtacgaccctcgccgttcncgacggtcctccgtcgtccgggaccaagtcncgtacctagactacggtnacgnggttcgacgtcgacgttacgaggagggtaccgagggtactaggtaaccgttaagtccggtactccgtgtacttattacggttaggtcggggttcgggttcgggttggggttcgggttaccgggacgggacggaacgtaggcggttactacccgggtacgtacgtacccgagacccggtacggtcccgtaaaccgtccccggtcggtactaccgtccgttaccccgtaccctactccgacgaccggcgtaaccgg

SEQ ID NO: 415843 - DNA, 604 bp, Homo sapiens
  misc_feature: GZ8MTXP02H6L2M.8.43.D10.1.454.CMB.2.raw
  modified_base (281)..(281): a, c, t, g, unknown or other
  modified_base (292)..(292): a, c, t, g, unknown or other
  modified_base (334)..(334): a, c, t, g, unknown or other
  modified_base (375)..(375): a, c, t, g, unknown or other
  modified_base (387)..(387): a, c, t, g, unknown or other
  modified_base (390)..(390): a, c, t, g, unknown or other
  modified_base (394)..(394): a, c, t, g, unknown or other
  modified_base (402)..(402): a, c, t, g, unknown or other
tcagctcgcgtgtccacgaccggtgctcgatttagactagcagtaaggggggcgccaggggtcccttccaatatcagcaccatggcctggactcctctcttttctgttcctcctcacttgctgcccagggtccaattctcagactgtggtgactcaggagccctcactgactgtcgtccccaggagggacagtcactctcacctgtgcttccagcacgtggagcagtcaccgagttggttactataccaacgtggtccagcaagaacctggacaagcaccngccatgattanagtaacaaacaacagactacctcgtacgacccctgccgttcncgacgcctcccgtcgtccgggaccaagtcctcgccctgacnctgtcgaggtgnacngcgngagcgagngtagagttatacgtcgctacgtcttactagtttagtcgggttgggttccgtttggggtcgggttcgggacgggacggtaccgtaggcgttaccggacgtaccgtacggtacgtaccggaccgacggtcccacccgtcccgtaccgttccgtaccgttccgtcccgttacccctacccgttccgacccgacgtacccgaccgg

SEQ ID NO: 415844 - DNA, 913 bp, Homo sapiens
  misc_feature: GZ8MTXP02GTI8W.8.43.D10.1.454.CMB.2.raw
  modified_base (202)..(202): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcgaggacgccctcactgactgtcgtaccccgaggagggacagtcactcncacctgtcgccttccagcacgtgggacgctacgtcaccgtaggttacggttaactactaacctaaacgttcggtaccagacaaacggtaaacccgtggaaccaaagcccgaacccgacggaccctacgttagtaattttaaacgtaagttaaaccaaaacaaaccgagaacctaacccgtccgtaccgggtaaccccctccgggtccccgtttccgtaccggtaaccggtcccctacccccggtttcggttaccccggggaaccctaaaaccgccgttaccccgtcccgtacggaaccccttacgtcgggtacggtacgggttaccgtggccccgtaaggcccggttaaggggaacgggaccgggacgggtacgttaaggggttaaactttaacgttccgtacgggttccgttaaccgtttacttaaccgttttaaaggttcggggtttaacgggggtttccgggggtttcggggttttaacgggggttcgggggtttaaccgggggaccgggggttaaccgggtaaaccggtacgggtaacgggtcccggttacccgtaaacgggttcccgtacggacccgggttaacccgaacggggttcccccgtaacccggtcccccggttaccggttacccgacccggtttccgtcccccgggttcccccgttaaacccccgttcccgacccggaacccggaccggttacccgggg

SEQ ID NO: 415845 - DNA, 583 bp, Homo sapiens
  misc_feature: GZ8MTXP02GXFFD.8.43.D10.1.454.CMB.2.raw
  modified_base (221)..(221): a, c, t, g, unknown or other
  modified_base (261)..(261): a, c, t, g, unknown or other
  modified_base (354)..(354): a, c, t, g, unknown or other
  modified_base (388)..(388): a, c, t, g, unknown or other
  modified_base (395)..(395): a, c, t, g, unknown or other
  modified_base (401)..(401): a, c, t, g, unknown or other
  modified_base (407)..(407): a, c, t, g, unknown or other
  modified_base (418)..(418): a, c, t, g, unknown or other
  modified_base (424)..(424): a, c, t, g, unknown or other
  modified_base (443)..(443): a, c, t, g, unknown or other
  modified_base (452)..(452): a, c, t, g, unknown or other
  modified_base (487)..(487): a, c, t, g, unknown or other
  modified_base (552)..(552): a, c, t, g, unknown or other
  modified_base (562)..(562): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacacgtcactctcactgtgcttccagcacgtggancagtcaccgtagtcgtactatccgaaacgttcggtaccanactaagaaaccctggacaagtccaacccgaggccaagtactaagttatagtaaacaaacaacaagtaccacgtctacgacccctgtcccgtcncacgcctcccgtacgtcggaccaagctcgtccanactacgngtacgngttcgncgacgcgtagngaccgngtacgtagattacgtgtcncgtatcctntattgcggtggtcgtgggttacggttcggacgggngaaccgtagtcgtacgaccgtcgtaggcacgacctacggccgtaccgtcccgtcgtcacccgttntcccgtaccncccgtctaccgacgtccgcgg

SEQ ID NO: 415846 - DNA, 669 bp, Homo sapiens
  misc_feature: GZ8MTXP02FK4IL.8.43.D10.1.454.CMB.2.raw
  modified_base (223)..(223): a, c, t, g, unknown or other
  modified_base (310)..(310): a, c, t, g, unknown or other
  modified_base (353)..(353): a, c, t, g, unknown or other
  modified_base (398)..(398): a, c, t, g, unknown or other
  modified_base (436)..(436): a, c, t, g, unknown or other
  modified_base (644)..(644): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgccccagggtccaattctcagactgtggtgactcaggagccctcactgactgtcgtccccaggagggacagtcactctcacctgtgccttcagcacgtggancagtcaccagttcgttaactactaccaaacgttcgttaccagacaaggaaacctggaacaacgccacccgaggccactagatttaanaagtaacaaacaacagacactcctacgacccctcgtcccgtcncgacgcctcccgttcgtacggggacctaacgctcgccctagaccncgtgtacgaggttgcgacgacgcgtagaggacgaggtntaggtagttacttacgctaccgtcgtacttacgttagtttagggtcgggttccgggttccggtttgggggtttacgggttcggggaaccgggggtaacgggaccggtaacggtacgtaccggtacccggttaccggtaaggtacccgaacgacccggtaaacggtcccgtccgtacccccgtcgaccgtactcccgtcccgtttcccncccgtccgtaccgacgaccgtccgg

SEQ ID NO: 415847 - DNA, 668 bp, Homo sapiens
  misc_feature: GZ8MTXP02HFYXH.8.43.D10.1.454.CMB.2.raw
  modified_base (374)..(374): a, c, t, g, unknown or other
tcagctcgcgtgtccacgaccggtgctcgatttagactagcagtaagggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccagcactggagcagtcaccagtgttactatccaaactgtccagcagaactgacaagcaccagcactgatttatagacaaacaaacagaacactcctacggacccctagccccgttctcacggcctccccgttccgtcggggacccaaagtctcgtccacgacnctcgtcgtaggtagttcggactacggccgtacgacgggaacgagggaccgtagtaacgttattaaccgttgcccgttaggtaccttacgttaacgtttagttcgggggttcggggttcgggtttcgggggttacggggttccgggggtacgggaccgggggtaaccgtaacgggtacgtaccggtaccggttacgtacgggtaccgacggtacccggacggtccgtaccggtcccccgtcggtaccaccgtccgttcccgtccctaccccgtcccgtacgacccgtacgcccgg

SEQ ID NO: 415848 - DNA, 596 bp, Homo sapiens
  misc_feature: GZ8MTXP02HOOXG.8.43.D10.1.454.CMB.2.raw
  modified_base (294)..(294): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcacgtggagcagtcaccagtgttactatccaactggtccagcagaactgacagcaccagccactagtattatagtaacaaanacagaacactacctccggacccctcgtcccggttctcgacgtcctcccctcgtccgggaccaagcctcgccctgactcgtgtcgagtgtcgacacgtccgtagaggacgaggcgtaggtagttacttacgtcgtccgtgcttacgttagtttagttgggtcgggtttcgttggggttcgggttcgggacgggacggtaaccgagtcgtacggtaccgtcgtacgtccgacgccgaacgtccgtaccgtccccgtcggtcaccgttccgtcccgtcccgtcccaccgtccgaccgtacgaccg

SEQ ID NO: 415849 - DNA, 617 bp, Homo sapiens
  misc_feature: GZ8MTXP02I9C7E.8.43.D10.1.454.CMB.2.raw
  modified_base (291)..(291): a, c, t, g, unknown or other
  modified_base (299)..(299): a, c, t, g, unknown or other
  modified_base (311)..(311): a, c, t, g, unknown or other
  modified_base (327)..(327): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtcgtccccaggagggacagtcactctcacctgtgcttccagcacgtggagcagtcaccagtgttactataccaaactggtccagcaagaaacctggacaagcaccaggccactgattanatacaaanacagacactccncgacccctgcccgttncacggcctcccgtcgtcggggaccaagctcgccctgacctctgtcgaggtgtgccagcccgtagacggacgagcgtagacgttatcgcgtacctgactcttaagttcggtgggttacgggtccgtttggggtcgggttaccggggacgggaacggtaccgtaaggtccgtacggtacccgttcgtacggtcgaccggtacccgaacggtcccgtaccggtcccccgtacggtcccgtaccgttccgtacccgttccccctaccccgtccacccggtaccgaccggtccgg

SEQ ID NO: 415850 - DNA, 648 bp, Homo sapiens
  misc_feature: GZ8MTXP02J1FPV.8.43.D10.1.454.CMB.2.raw
  modified_base (205)..(205): a, c, t, g, unknown or other
  modified_base (286)..(286): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtncttccagcactggagcagtcaccagtgttactatcaaactggttcagcagaacctggacaagccaccagccactgatttanagtacaaacaacagacactccacggacccctgtacccgttctcacggtcctcccgtccgttccggggaccaaacggcctacgtcccctgacctcgcgtacacggtgtcgcgacgtcccgtagacggacggaggcgtaggagttactacgtcgaccgtgtaccttcgttaagttgtcggggtcgggtccggtttcggggttggttccggggacggacgggggtaccgaaggtccgtaacggtccggtaccgtacggtaccacggtacccgaacggtccgacccggtcccccggtaccggtcgtaccccgttccgttacccgttcccccgtacccccgttccgtacccgaccggtaccgcccgg

SEQ ID NO: 415851 - DNA, 625 bp, Homo sapiens
  misc_feature: GZ8MTXP02GHX8P.8.43.D10.1.454.CMB.2.raw
  modified_base (219)..(219): a, c, t, g, unknown or other
  modified_base (282)..(282): a, c, t, g, unknown or other
  modified_base (288)..(288): a, c, t, g, unknown or other
  modified_base (368)..(368): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtggttactatccaaactggttccagcagaaacctggacaagcacccagccacngattanagtacaaacaaacagacactcctgacccctgcccgttctcaggtcctcccctcttcggggaccaaagcctcgccctgacnctgtctaggtgtgcacgcctgaggtacgagcgtagaagttattactcggtcctagtctacttagttagtgggtcgggtacgtttggggtggtttcgggacgggtacggaccgaacggcgtacggaccgttccgtacggttaccgaccggcccgtaaacggccgttcccggccccccgttccgggtccctaccgtttcccgttccccggtttaccccctacccccgttccccgttaccggacccgtaacggtccccgg

SEQ ID NO: 415852 - DNA, 600 bp, Homo sapiens
  misc_feature: GZ8MTXP02JBOJQ.8.43.D10.1.454.CMB.2.raw
  modified_base (281)..(281): a, c, t, g, unknown or other
  modified_base (307)..(307): a, c, t, g, unknown or other
  modified_base (355)..(355): a, c, t, g, unknown or other
  modified_base (383)..(383): a, c, t, g, unknown or other
  modified_base (395)..(395): a, c, t, g, unknown or other
  modified_base (468)..(468): a, c, t, g, unknown or other
  modified_base (508)..(508): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtcccaattctcagactgtggtgactcaggagccctcactgactgtcgtccccaggagggacagtcactctcacctgtcgccttccagcctacgtgggaacgcacgtacaccgtagttcggttactactccaaacgttgttccagcaacgaacngacacgcaccgaggccactgtattanacgtaacaaacaacgcgacactccgtacggacccctcggtcccgttcncgacgtccctcctcgtccggaccaagcncgtcctacgacncgtgtcgtacggtgtcgcacgccgtaggacggtacggacgccgttagtaacgttaacgtctcggtcctgcttntagttgtgggtcggtcgttgggtcggtcggcggaggtacnggtcgccgtacgtcgtacggtcacgaccggacgccgtccgcccgtccgctacctccgtcctaacccgtcccgtcctaccgaccgtacggccg

SEQ ID NO: 415853 - DNA, 539 bp, Homo sapiens
  misc_feature: GZ8MTXP02JRRDS.8.43.D10.1.454.CMB.2.raw
  modified_base (289)..(289): a, c, t, g, unknown or other
  modified_base (327)..(327): a, c, t, g, unknown or other
  modified_base (364)..(364): a, c, t, g, unknown or other
  modified_base (374)..(374): a, c, t, g, unknown or other
  modified_base (389)..(389): a, c, t, g, unknown or other
  modified_base (401)..(401): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggtccagcagaaacctggacaagcaccaggccactgatttanagtacaaacaacagacactcctggacccctgcccgttncagtcctcccgtctcggggccaaagctcgccctgacncgtgcaggtntgcagcctgagacgngctgagtatacngctgctctattagtggtcggtcgttgggtcgttcggcggtaggacagctcgaccgttccgagtcgtacgaccgacggcgtccgcccccgtcgggtccacgtccgtccgtcccgtccccgtccgtccgacccgcgaccg

SEQ ID NO: 415854 - DNA, 750 bp, Homo sapiens
  misc_feature: GZ8MTXP02HQH33.8.43.D10.1.454.CMB.2.raw
  modified_base (224)..(224): a, c, t, g, unknown or other
  modified_base (428)..(428): a, c, t, g, unknown or other
  modified_base (434)..(434): a, c, t, g, unknown or other
  modified_base (441)..(441): a, c, t, g, unknown or other
  modified_base (454)..(454): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccagggaggacagtcactctcacctgtcgcttccagcacgtggancacgtcaccgtagtggttaacctactacctaaacgttcggttaccaagcaaacgaaaccctggaaaccaacgacccaacccgaggcccaacgtagtaattttaacgaacgtaaaccaaaacaacgaacgaacctacctccgtaccggacccctttcggccccgttcacgacggtccctcccgtacggtccgggaaccaagtccncgtccngactcgngtcagggttcgcncgtacgtccgaggacggaccggtagcgtaggtaacgttacgttcgtacggtaccctggtacccttacggttaacgttagggttcggggtttacgggggtttccggtttgggggttacggttaaccgggggccggggtaaacgggtacccgtaaagggtccgttacggtaacccggtttcggaaacggtccgaaaccgggcccggaaacggtcccgtaccccggtccccgtcggtaccctcgtttccccggtacccttacccccgtccctaaccgtcccggacccgtacgtaaccgg

SEQ ID NO: 415855 - DNA, 629 bp, Homo sapiens
  misc_feature: GZ8MTXP02FY2K3.8.43.D10.1.454.CMB.2.raw
  modified_base (314)..(314): a, c, t, g, unknown or other
  modified_base (346)..(346): a, c, t, g, unknown or other
  modified_base (547)..(547): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtcgtccccgaggagggacagtcactctcacctgtcgccttccagcactggagcagtcacctagtcgttactataccaaacgtgttaccagacagaaacctggacaacgccacccgagccatgtaattataagtaacaaacaanacgacactcctacggacccctggtcccggttntcgacggtcctcccgtcgtccggggacctaagctcgccctagacctcgtgacgtaggtcgtgacaacgccgtaggacggacgagtacgtgtagttacttcgcggtcctgtacctagtttaaacgttgtcggggttacgggttccgtttggggtcggttcgggacggtacgggacaacgtcgtaccgaccgtcgtaacgtcncggacccgacgtcctaccggccccgtcgtacctaccgtccgttaccgttacccccacctttcccgacgacccgacggacccg

SEQ ID NO: 415856 - DNA, 572 bp, Homo sapiens
  misc_feature: GZ8MTXP02HBTPF.8.43.D10.1.454.CMB.2.raw
  modified_base (199)..(199): a, c, t, g, unknown or other
  modified_base (262)..(262): a, c, t, g, unknown or other
  modified_base (273)..(273): a, c, t, g, unknown or other
  modified_base (278)..(278): a, c, t, g, unknown or other
  modified_base (285)..(285): a, c, t, g, unknown or other
  modified_base (287)..(287): a, c, t, g, unknown or other
  modified_base (297)..(297): a, c, t, g, unknown or other
  modified_base (319)..(319): a, c, t, g, unknown or other
  modified_base (341)..(341): a, c, t, g, unknown or other
  modified_base (349)..(349): a, c, t, g, unknown or other
  modified_base (357)..(357): a, c, t, g, unknown or other
  modified_base (368)..(368): a, c, t, g, unknown or other
  modified_base (400)..(400): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccagggaggacagtcactcncacctgtcgcttccagcactggagcagtcacgtagttgtactatacaatcgtcagcaagaacnggacagcaccngcacngtattananaacaaacaanagacactcgacgccctgccgtncagcctccgtctcggacaagcncgctgacncgtgacgnggtgcgcgacnccgtagaggacgagtctgtaagtaacttacgngtctgtctacttaagttggtagggtcgggttaggttcgggtcgggttcgggacgggtaggaacgacgtcgtaccgtaccgtcgtacgccggaacgtccgaacgtccgtaccgtcccgttacgacctccgttcccgtccgccccgtcccgtccgtacccggaccgtacggccg

SEQ ID NO: 415857 - DNA, 666 bp, Homo sapiens
  misc_feature: GZ8MTXP02HE6A2.8.43.D10.1.454.CMB.2.raw
  modified_base (256)..(256): a, c, t, g, unknown or other
  modified_base (261)..(261): a, c, t, g, unknown or other
  modified_base (293)..(293): a, c, t, g, unknown or other
  modified_base (296)..(296): a, c, t, g, unknown or other
  modified_base (303)..(303): a, c, t, g, unknown or other
  modified_base (348)..(348): a, c, t, g, unknown or other
  modified_base (371)..(371): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccgaggagggacagtcactctcactgtgcttccagcacgtgagcagtcacagtgttactatccaaatgtcagcacaacngacancaccagcatgattatagacaaacacacacacnccncgacccncgtccgtctcgacgctccgtcgtcgggacaaagcacgctacgacnctcgtctagtgtacggctacgcngacggacggagtccgtacggtaagttacttaccggtaacgtccctaacggtccttcgttagttaaggtttcgggtaacggggtttcccggtttagggggtttcgggtaaccggggttcgggaaccggggtaacgaacggtacgtaaccggtaccgtacccgttacgggttaccgaacccggtacccggtaaacggtccggttacccgtcccccggtaaacgtttcccggtaaccgttcccgtccggtttacccccaaccccgtttcccgtaccccggaccgttaaaccgcccggg

SEQ ID NO: 415858 - DNA, 642 bp, Homo sapiens
  misc_feature: GZ8MTXP02JF9ZO.8.43.D10.1.454.CMB.2.raw
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggacgccctcactgactgtcgtccccaggagggacagtcactctcacctgtgccttccagcacgtggagcagtcaccgagttcggttactatccgaaacgttggtccaggtcaacgaaaccgtggaacaagccaccgaggccaacgtgtatttaatacgtaacaaacaacagtacacctcgtacgacccctgacccgttctccagtcctacctcgttacggggaccaacgctcgcctcgaactcgtgtcaggtcgtgcgcgcgtggacgacggagcgtagagttaacttcgtcgcctggtccttacgttagtttaggtcgggttcggggttcggttgggttcggggtttacggggaccgggtacgggaccgtaagtcggtaccgtaccggtcgtacggaccgtcggaaaccgtaccggcttcccggtccccgtcggtcctaccgtcgttcccgtaacccctcccgtcccgtaccgaccgacgtccgg

SEQ ID NO: 415859 - DNA, 589 bp, Homo sapiens
  misc_feature: GZ8MTXP02I2JLV.8.43.D10.1.454.CMB.2.raw
  modified_base (165)..(165): a, c, t, g, unknown or other
  modified_base (221)..(221): a, c, t, g, unknown or other
  modified_base (257)..(257): a, c, t, g, unknown or other
  modified_base (285)..(285): a, c, t, g, unknown or other
  modified_base (295)..(295): a, c, t, g, unknown or other
  modified_base (326)..(326): a, c, t, g, unknown or other
  modified_base (373)..(373): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagacctgtggtgactcaggagccctnactgactgtgtccccaggagggacagtcactctcacctgtgcttccagcactggancagtcacagtgttacatccaagtggtcagcagaacnggacaagcacccaggccactgtatttanagtaacaaanaacagacacctccgcggaccctcgcccgttnccgagcctccgtcgtcgggaccaagctcgcctgactcgtgcgaggtncgacgcgtcgagacggacgacgcgagtaagtagttactcgctacgtactcttagtcgttcgggcggttccggtttagggttcgggttacgggacgggtacggacgtaacggtcgttacggacccgttacgtaccggtacgtaccgacccgaacggtccgtccgtaccccgtcggaccctacgtcctacgttccccaccgtcctcgaccacggaccg

SEQ ID NO: 415860 - DNA, 595 bp, Homo sapiens
  misc_feature: GZ8MTXP02G3QG0.8.43.D10.1.454.CMB.2.raw
  modified_base (253)..(253): a, c, t, g, unknown or other
  modified_base (257)..(257): a, c, t, g, unknown or other
  modified_base (274)..(274): a, c, t, g, unknown or other
  modified_base (279)..(279): a, c, t, g, unknown or other
  modified_base (284)..(284): a, c, t, g, unknown or other
  modified_base (316)..(316): a, c, t, g, unknown or other
  modified_base (384)..(384): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtgtactatccaaactgtcagcanaacnggacagcaccagcactnattanagtanaaacaacagacatcctgacccctgcccggttncagctccctacttcggggccaaagctgcccctagacacgtgcaggtgtcgcagcctgagacgaggtcngagtattactgtcctgctctattatggtgggtaccgttggggtgtttacgggcgggtaaggggaccgaaacggtacgttcggaacccgttccgtaaacggggttccaaaacggcccccgaaaaggggtcctacggtcccccccttcggggtaccctaacctccgttctttacccccggcccccttcccgttccggaacccaaccggaccgg

SEQ ID NO: 415861 - DNA, 633 bp, Homo sapiens
  misc_feature: GZ8MTXP02FYPHL.8.43.D10.1.454.CMB.2.raw
  modified_base (219)..(219): a, c, t, g, unknown or other
  modified_base (281)..(281): a, c, t, g, unknown or other
  modified_base (322)..(322): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcacagtgttactatccaaatggtcagcagaactggacaagcaccagccactgatttanagtaacaaacaacagacactcctcggacccctgccccgttntcacgctccctcgtcgggccaagctcgccctgactcgtgtccgagggttctgcgacgtcccgtaggacggaccggaggctaggaagttattacgtgcccttgtaccttgttattaggtgggtcggggtccgtttggggttcggtttacggggcggtacggggtaccctaaggtccgttcggtaacccggtcccgtaaggggttacccaaggtcccccggaaaggtcccgttacccggcccccccgttcggtccctacccgttccgttcccgttcccccgtcccctacccgtaccgaccgtaccggacccgg

SEQ ID NO: 415862 - DNA, 611 bp, Homo sapiens
  misc_feature: GZ8MTXP02FKAQK.8.43.D10.1.454.CMB.2.raw
  modified_base (219)..(219): a, c, t, g, unknown or other
tcagctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggancagtcaccagtgttactatccaaatgtccagcagaaacctggacaagcacccaggccatgatttatagtaacaaacaacagacactcctcggacccctgcccgtctcacggctcccctcgtcgggccaaagctacgccctgacctactgtcaggttgtcgacagccctggacggtacgaggcgtagagttactactcgcccttgcgttacttagttagtgggtcggtccgttgggttcggtttcgggccgggagggacccaaggtccgtacggacccgttaccgtacggtacgaccgacccgaaacgggccgtccgtacccccgttacggtacccgtaccgttccgttccggttcccccgtccccgtacccgtaccgacgaacccggtccgg

SEQ ID NO: 415863 - DNA, 634 bp, Homo sapiens
  misc_feature: GZ8MTXP02G6DXU.8.43.D10.1.454.CMB.2.raw
  modified_base (164)..(164): a, c, t, g, unknown or other
  modified_base (219)..(219): a, c, t, g, unknown or other
  modified_base (284)..(284): a, c, t, g, unknown or other
tcagctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctnactgactgtgtccccaggaggacagtcactctcacctgtgcttccagcactggancagtcaccagtgttacatacaaactggtccagcagaaacctggacaagcaccgagccatgattanagtacaaacaacagacactcctcggacccctcgcccggttcgtcacggcctcccctccgttcggggaccaaaagcctcgtcccttgaacctctcgtcacgggtgtagcgagccttaggaggaacgaggtcgtaggaacgttagttaacctcggtaccctggtcccttagttaacgtttagtgggttcggggtccgtttggggttagggtttaccgggccggggaagggacccgtaaagccgtaccgtaccgttaccgaggttaccgacgacccgaaacggtcctaccggtcccccggtacgtccgactcccgttcgtaccccgtcccctccgttaccaccgtacgaccgg

SEQ ID NO: 415864 - DNA, 575 bp, Homo sapiens
  misc_feature: GZ8MTXP02HNVAP.8.43.D10.1.454.CMB.2.raw
  modified_base (204)..(204): a, c, t, g, unknown or other
  modified_base (283)..(283): a, c, t, g, unknown or other
  modified_base (290)..(290): a, c, t, g, unknown or other
  modified_base (292)..(292): a, c, t, g, unknown or other
  modified_base (303)..(303): a, c, t, g, unknown or other
  modified_base (325)..(325): a, c, t, g, unknown or other
  modified_base (356)..(356): a, c, t, g, unknown or other
  modified_base (376)..(376): a, c, t, g, unknown or other
tcagctcgcgtgtccacgaccggtgctcgatttagactagcagtaagggggcgccagggtcccttccaatatcagcaccatggcctggactcctctctttctgttcctcctcacttgctgcccagggtccaattctcagactgtggtgactcaggacgccctcactgactgtcgtcccaggaggacagtcactctcacctgtcncttccagcacgtgagcagtcactagtgttactactaccaaactggtaccagacaagaaacctggacagcaccagcctangatttananaacaaacacanacactcacgtacctcgtccgtncgacgtcctcctcgtccggacacgtctcgcncactctcgtcgagtagcacngccgagacgacgtagactaggtacgttacgttactcgtcgtacgtactacgttagttagttcggttcggttcggttgggttacgggtcggacggacggacgacgtacgtacgtaccgtacgtacgtacgacgaccgacgtacgtaccgtccgtccgtcgtactccgtcctacccgtaccgtaccgtaccgaccgacgcg

SEQ ID NO: 415865 - DNA, 553 bp, Homo sapiens
  misc_feature: GZ8MTXP01DHR8O.13.35.D02.1.454.CMB.2.raw
  modified_base (279)..(279): a, c, t, g, unknown or other
  modified_base (304)..(304): a, c, t, g, unknown or other
  modified_base (367)..(367): a, c, t, g, unknown or other
  modified_base (394)..(394): a, c, t, g, unknown or other
  modified_base (419)..(419): a, c, t, g, unknown or other
  modified_base (423)..(423): a, c, t, g, unknown or other
  modified_base (426)..(426): a, c, t, g, unknown or other
  modified_base (428)..(428): a, c, t, g, unknown or other
  modified_base (438)..(438): a, c, t, g, unknown or other
  modified_base (440)..(440): a, c, t, g, unknown or other
  modified_base (443)..(443): a, c, t, g, unknown or other
  modified_base (445)..(445): a, c, t, g, unknown or other
  modified_base (471)..(471): a, c, t, g, unknown or other
  modified_base (493)..(493): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagcgtgagtttcctacggctgactatttaaaggtgtccagtgtgaggtgcaagtggtggagtcgtgggggggggcttggttaagccgtggggggtccctcagactctcctgtgcaacctctggattcattttcnctgacgcctggttgagctgggtccnccaggctcccgggagggctggagtggttgccgtattaaaggtagaagacatggtcggacaacngactaccagtgtcccgtgaaaggcagnttcactatcacaagagatgactaanaaanaananatatatatananaananaacaacaaggaaagagagacgagagngtagtatactatacacagaagngcgagagtagagaagcgacgaacgacgtaacgtacgtacgttacggtcgggccgggaacg

SEQ ID NO: 415866 - DNA, 557 bp, Homo sapiens
  misc_feature: GZ8MTXP01C7I68.13.35.D02.1.454.CMB.2.raw
  modified_base (242)..(242): a, c, t, g, unknown or other
  modified_base (276)..(276): a, c, t, g, unknown or other
  modified_base (393)..(393): a, c, t, g, unknown or other
tcagtcacgtactacacgaccggtgctcgatttagcacacgatagttgggtttgggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagcctggggggtccctnagactctcctgtgcaacctctggattcattttcnctgacgcctggttgagctgggtccgcaggctcccgggaagggctggagtgggtggccgtattaaaggtagaagacagtggtcggacaacagactacagtgttcccgtgaaaggcagnttcactatctcaagagatgactacaaaagaatgaatatatctgacaaatgaaacaacctaggaaaagcgaaggacacaggcgtagtaattactgtaccacagaatgggccaggatgcaaagttggaccgcgacgaagttcgacttacgtcgggggcccggaacg

SEQ ID NO: 415867 - DNA, 557 bp, Homo sapiens
  misc_feature: GZ8MTXP01BUPMU.13.35.D02.1.454.CMB.2.raw
  modified_base (277)..(277): a, c, t, g, unknown or other
  modified_base (357)..(357): a, c, t, g, unknown or other
  modified_base (387)..(387): a, c, t, g, unknown or other
  modified_base (504)..(504): a, c, t, g, unknown or other
  modified_base (529)..(529): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagcctggggggtccctcagactctcctgtgcaacctctggattcattttcnctgacgcctggttgagctgggtccgcaggctcccgggaagggctggagtggtgccgtataaaggtgagacatggtcgganaacagactacagtgtcccgtgaaaggcagnttcactatctacaagagatgactacaaaagaatgaatatatctagacaaatgaaacaacctaggaaaagcgaaggacacaggcgtgtaattactgtaccacagaatggggccaaggntaggacaaagttcggaccgcgacgngttcgacgttacgtgggggccccggaag

SEQ ID NO: 415868 - DNA, 610 bp, Homo sapiens
  misc_feature: GZ8MTXP01DXMGW.13.35.D02.1.454.CMB.2.raw
  modified_base (245)..(245): a, c, t, g, unknown or other
  modified_base (265)..(265): a, c, t, g, unknown or other
  modified_base (415)..(415): a, c, t, g, unknown or other
  modified_base (430)..(430): a, c, t, g, unknown or other
  modified_base (448)..(448): a, c, t, g, unknown or other
  modified_base (477)..(477): a, c, t, g, unknown or other
  modified_base (481)..(481): a, c, t, g, unknown or other
  modified_base (484)..(484): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggatttttcctcgctgcttattttaaaaggtgtccagtgtgaggtgcaagtggtggagtcgtggggggggcttggttaagccgtgggggtccctnagactctcctgtgcaacctntggattcattttctctgacgcctggttgagcgtgggtcccgccgaggccgtccccggggaagggctgggagtgggttggccgttaagttaaaggtagaagacagtgggacgacaacagactaccgagtgtacccgtaggaaacgcaagtnttacaactatactanaagaagatagaactaaanaaaagaaatagaattaatatactagaaanaaanaanaaacaacaaggaaagaagaagaacgaacgagagtagtattactactacacagaagacggacgagagagaagaacgcggaccgaacgacgtaacgtacgtacgttacggtaacgggaaccgggaacg

SEQ ID NO: 415869 - DNA, 680 bp, Homo sapiens
  misc_feature: GZ8MTXP01D07BY.13.35.D02.1.454.CMB.2.raw
  modified_base (278)..(278): a, c, t, g, unknown or other
  modified_base (304)..(304): a, c, t, g, unknown or other
  modified_base (488)..(488): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtgggggtccctcagactctcctgtgcaacctctggattctattttcnctgacgcctggttgagcgtgggtccnccgaggcctccccggaggaaggggctgggagtggggttgaccgttaagttaaaggtagaagacagtggtacgacaacgacgacctacgagtcgttcccggtagaaaaacgggcaaggtattaccgaacttatcctacgaaagagtatagaactaacgaaaaagtaatagaaattatatcgtaanaacaaataacgaaacaaacggaaagaaacgacgaacgacgacgaggtacgttaagttacttacgtacgtaaccgaagaacggtacgttacgggaacaagtaacgtacggaacgttaacggttccggaacccggtacggtaacggtaaccggttaccggaaccggttaaccggggaacccgggggtaacccgg

SEQ ID NO: 415870 - DNA, 555 bp, Homo sapiens
  misc_feature: GZ8MTXP01C1S6P.13.35.D02.1.454.CMB.2.raw
  modified_base (292)..(292): a, c, t, g, unknown or other
  modified_base (304)..(304): a, c, t, g, unknown or other
  modified_base (389)..(389): a, c, t, g, unknown or other
  modified_base (398)..(398): a, c, t, g, unknown or other
  modified_base (403)..(403): a, c, t, g, unknown or other
  modified_base (417)..(417): a, c, t, g, unknown or other
  modified_base (472)..(472): a, c, t, g, unknown or other
  modified_base (501)..(501): a, c, t, g, unknown or other
tcagtcacgtactacacgaccggtgctcgatttagcacacgatagttgggtttgggggggagaggagccccagccttgggattcccaagtgttttcattcagtcatcaggactgaacacagaggactcaccatggagtttgggctgagctggattttcctcgctgctattttaaaaggtgtccagtgtgaggtgcaagtggtggagtcgtgggggggggcttggttaagccgtggggggtccctcagactctcctgtgcagcctctgggttcaccgtcagtcacacctacangagctgggtccnccaggctccgagggaagggctggagtgcgtctcttttatttatagtagtgtagtacatactcccgcagctccgtgaacggggccntcaccatcncaganacatcaagacacgntgttactacaaatgaacagcctagagagcgatgacacgctgtatactgtgcgagngaagtcggggacccaacggaaacgttacncgacgttgttacggaacgtcgtcggggaccaaggggacctaacggcgtaacccg

SEQ ID NO: 415871 - DNA, 697 bp, Homo sapiens
  misc_feature: GZ8MTXP01A3PRI.13.35.D02.1.454.CMB.2.raw
  modified_base (282)..(282): a, c, t, g, unknown or other
  modified_base (611)..(611): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgcttattttaaaaggtgtccagtgtgaggtgcaagtggtggagtcggtgggggggggtcttggttaagccgtggggggtccctgagactctcctgtgcaacctctgattctattttcnctcgacgtccgtggttgagtcgtcgggtccgccgaggccgtccccggggaagggtcgtgggaggtgggttcggaccgttaagttaaagggtagaagacagtgggtacgaacaaacgacgtaacctacgacggttcgtacccgtagaaacggcaaggtaacttaccaacttaactaccgtacaaaggacgtagtacgtaaacctaaagaaaaaggtaatagaacttaatactagtagaacaaagtacgaaactaaccgaagggaaaacgacggaagaacgacgaggtcgtagttacgttactaacgtaccagtagaagtcgggacaaggngtaacgaacgttaaacgttcggggacccgtaaggaaccgtcggtaccgtaccgggttaccgggtccgggggaaccccgggtaacgg

SEQ ID NO: 415872 - DNA, 625 bp, Homo sapiens
  misc_feature: GZ8MTXP01E08T6.13.35.D02.1.454.CMB.2.raw
  modified_base (276)..(276): a, c, t, g, unknown or other
  modified_base (411)..(411): a, c, t, g, unknown or other
  modified_base (427)..(427): a, c, t, g, unknown or other
  modified_base (462)..(462): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaggtgtccagtgtgaggtgcaagtggtggagtcgtgggggggcttggttaagccgtgggggtccctcagactctcctgtgcaacctctggattctattttcnctgacgtcctggttgagcgtgggtcccgcagggccgtcccggggaagggctgggaggtgggttggccgtaagttaaaggtagagacagtggtacggacaaacgagactaccagtcgtcccggtagaaaggcagtnttcatatctacaaganatcgaactacaaaaagaatgaactaatattcgaanaacaaatacaaacaacgaagggaaacgacgaacgaacacggtagtacgtagtaactacgtacgaccaacgaggaacggtcggacgaagttacgtacgaacgaaggccggaccggtaacgtacggtaacgtaccgacggttaccgggtccggggaaccgtaacg

SEQ ID NO: 415873 - DNA, 712 bp, Homo sapiens
  misc_feature: GZ8MTXP01ATM4E.13.35.D02.1.454.CMB.2.raw
  modified_base (280)..(280): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcggtgggggggtcttgggtaagccgtgggggtccctgagactctcctgtgcaacctctggtattctattttcnctgacgtccgtggtgagcgtcgggtccgcgaggccgtccggggaagggcgtgggaggttgggtcggaccgtaagttaaaggaggaagacaggtagggtacgaacaacgacgactaaccgtaggtcgttacccggtaagaaacggtacaagtaacttaccgaacttactacgtaacgaaagagtaactacgaaactaaacgaaaaagtaaatagtaattaattaacgtactagaacctaaataacgaaacctaaaccgtaagggaaaacgcggaaacgtaacgaacgtacgggtacgtaacgttaactaccgtacgtaaccacgtaagtaaggtccggaaccgagttacgacggaacgttaaacggttccgggaccgtaacggtacgtaacgttacccggtacggttaccgggtccggggaacccgggtaacg

SEQ ID NO: 415874 - DNA, 606 bp, Homo sapiens
  misc_feature: GZ8MTXP01ALUVO.13.35.D02.1.454.CMB.2.raw
  modified_base (452)..(452): a, c, t, g, unknown or other
  modified_base (542)..(542): a, c, t, g, unknown or other
  modified_base (564)..(564): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggtcttggttaagccgtgggggtccctcgagactctcctgtgcaacctctggattctattttctctgacgcctggttgagcgtgggtcccgccgaggccgtcccggggaagggctgggaggtgggttggccgtattaaaggtagaagacagtggtacgacaacagactaccgagtgttcccgtagaaaggcagaattcactatctacaagagatgaactaacaaaagaaatgaatanatactagacaaagtagaaacaacctaggaaaacgcggaagaaccacgaggcgtagtaacttactacgtaacccagagaatgggaccaagntagaaccaaagttcggacccgngacgtaacggtaccgacgttacggtcggggaacccggaaccg

SEQ ID NO: 415875 - DNA, 630 bp, Homo sapiens
  misc_feature: GZ8MTXP01D73WP.13.35.D02.1.454.CMB.2.raw
  modified_base (278)..(278): a, c, t, g, unknown or other
  modified_base (596)..(596): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggaggtcgtggggggggcttggttaagccgtgggggtccctcagactctcctgtgcacctctgtattctattttcnctgacgcctggttgagcgtgggtcccgccgtacggccgtccccggggaagggcgtgggaggttgggttggaccgttaagttaaaggtagaagacagtggtacgaacaacgagactaccgagtcgtacccgtagaaaggcaagtaattcaactatctacgaagagtatagaactaaagaaaagaatagaataactatactagaactaaatacgaaacaaaccgtaagggaaaacgcggaaacggtaacaacgaaggtacgttaggttaacttacgtacgtaacccaagagaagtcggacagatagacaaagttcgacgngacgaagttcgacgttcggcgggaaccggtaacg

SEQ ID NO: 415876 - DNA, 587 bp, Homo sapiens
  misc_feature: GZ8MTXP01BP8ZF.13.35.D02.1.454.CMB.2.raw
  modified_base (278)..(278): a, c, t, g, unknown or other
  modified_base (405)..(405): a, c, t, g, unknown or other
  modified_base (422)..(422): a, c, t, g, unknown or other
  modified_base (490)..(490): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctcagactctcctgtgcaacctctggattcattttcnctgacgcctggtgagcgtgggtccgcaggcgtcccgggagggctgggagtgggttggtcgtaagttaaaggtagaagacagtggtacggacaacgagactacgagtcgttcccgtagaacggcagtnttcactatctacaaganatgactaacaaaagaatgaatatatctagacaaatgaaacaaccgtaggaaaacgcggaagacaacgnggtcgtagtacttacgtgtaccacgagaagtcgggaccagactgaacaagttcggaccgtcgacgtgttacgccttacgggtccgggcccggtaacg

SEQ ID NO: 415877 - DNA, 632 bp, Homo sapiens
  misc_feature: GZ8MTXP01EJH49.13.35.D02.1.454.CMB.2.raw
  modified_base (233)..(233): a, c, t, g, unknown or other
  modified_base (348)..(348): a, c, t, g, unknown or other
  modified_base (371)..(371): a, c, t, g, unknown or other
tcagtcacgtactacacgaccggtgctcgatttagcacacgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacntgcaatcttaaatggtatcagcagaagtcagggacaacgccccgaactcctgactctacgtacatcctactttgacacgagtcggactcccatccaaggttcaagtgcaagtagntctaggaactagtactttacccnctacagtacgtagggtctacgacgaccgttagaaacggttattttacggacgttaaccgtttaacgttaatttacggtacgtaaacgtaaggttaacccgttttaaaccccgtttccccgtaccccccggtaacggtttaccggtaacccggaaacggttaaccggaaaccggttaagggaactaacgaacgacggtaccttaggacgttcgttacgcgacctaactcgtcgttcttcgttaccttccgttccccgtaacc

SEQ ID NO: 415878 - DNA, 666 bp, Homo sapiens
  misc_feature: GZ8MTXP01BI74E.13.35.D02.1.454.CMB.2.raw
  modified_base (278)..(278): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggtcttggttaagccgtgggggtccctcagactctcctgtcgcacctctggattctattttcnctgacgccgtggttgagcgtcgggtcccgccgacggccgtccccggggaagggcgtgggaggtgggttggaccgttaagttaaaggtagagacagtggtacgacaacagactaccgagtcgtcccgtagaacggcagtcttacatactactacaagagatagaacttaacgaaaaagaatgaattaatatctagaactaaataacgaaactaaccgtaagggaaaacgacggaacgaacgaacgacggtcgtagttaacttacgtacgtaacccagaggtaacgtacggaccaagttacgtaagaaccgaaagttccgggaccgaaccggtacggtaacggtttcccggaacggttaccggggttccgggggaaccccggggtaaccg

SEQ ID NO: 415879 - DNA, 703 bp, Homo sapiens
  misc_feature: GZ8MTXP01C1PLF.13.35.D02.1.454.CMB.2.raw
  modified_base (278)..(278): a, c, t, g, unknown or other
  modified_base (469)..(469): a, c, t, g, unknown or other
  modified_base (501)..(501): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtgggggtccctcagactctcctgtgcaacctctggattctattttcnctgacgtcctggttgagcgtgggtcccgccgaggccgtaccccgggggaagggtccgtgggagggttggggttcgggccgttaaagttaaaagggtagaagtacgtagtgggtacggaactaaacgagaacctaccgaggttcgttcccgtagaaaggcagtcttacactatctacaagagatagactaanaaaagaatgaataatatactagaacttaaaanaacgaaaccgaaacgaagggaaaacggacggaaacggaacgaacggtaacggtacgttagttaaacgttacgtaaccgtaaccgaacgaaggtaacggtacgggactaaaggacgtaacgaacgttaaacggttcgggaccggaaccggtaacgtaaccggttaccgacggttaccggggtaaccgggggaacccggtaacg

SEQ ID NO: 415880 - DNA, 668 bp, Homo sapiens
  misc_feature: GZ8MTXP01BKHG4.13.35.D02.1.454.CMB.2.raw
  modified_base (280)..(280): a, c, t, g, unknown or other
  modified_base (422)..(422): a, c, t, g, unknown or other
  modified_base (441)..(441): a, c, t, g, unknown or other
  modified_base (453)..(453): a, c, t, g, unknown or other
  modified_base (476)..(476): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgcttaattttaaaaggtgtccagtgtgaggtgcgaagtggtggagtcggtgggggggtcttggttagccgtcgggggtcctcgagactctctgtgcactcgtgtattctattttcnctgacgtctggtgacgcgtcggtccgcgacggccgtaccggggagggcgtggaggtgggtcggaccgttaaagtaaaggtagaagacgagtggtacggaacaacgagaactacgaggttcgtacccgtagaaacgtcaagtntcaacttacactacaaganatacgaactaanaaaagatagaattatactacganaactaaagacgaaacctaaccgtaaaggaaaacgcggaaacgaacgaagacggtgttagttaaacttacgtacgtaaccagtaagaagtcggacctagacgttacgaagaaacgttccggacccggtaagtaccggtaacggtttaccgaaccggttaccggggtaacccgggggttaacccggtaaaccgg

SEQ ID NO: 415881 - DNA, 610 bp, Homo sapiens
  misc_feature: GZ8MTXP01D5W29.13.35.D02.1.454.CMB.2.raw
  modified_base (277)..(277): a, c, t, g, unknown or other
  modified_base (338)..(338): a, c, t, g, unknown or other
  modified_base (341)..(341): a, c, t, g, unknown or other
  modified_base (352)..(352): a, c, t, g, unknown or other
  modified_base (356)..(356): a, c, t, g, unknown or other
  modified_base (363)..(363): a, c, t, g, unknown or other
  modified_base (382)..(382): a, c, t, g, unknown or other
  modified_base (396)..(396): a, c, t, g, unknown or other
  modified_base (437)..(437): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagcctggggggtccctcagactctcctgtgcaacctctggattctattttcnctgacgcctggttgagctgggtccgccaggctcccgggaggctggagtggtgcgtataagnganacatggtcganaacngactacngtgtccgtagaaaggcagntcactatctcaagnatagactaacaaaagaaatagatatatctagacaaaagtanaaacgtaaaccgtacggaaaaaacggcggaaaacgggaccaaacgaacgggacgttaggttaaacttacgtacgttaaaccacgaacgtaatcgggaccgtagaagtagacaaaagttcggaccggaacggacgaacggttaccgacgttaccggtcggggcccgggaacggg

SEQ ID NO: 415882 - DNA, 572 bp, Homo sapiens
  misc_feature: GZ8MTXP02JDQ0O.13.35.D02.1.454.CMB.2.raw
  modified_base (395)..(395): a, c, t, g, unknown or other
  modified_base (502)..(502): a, c, t, g, unknown or other
tcagtcacgtactacacgaccggtgctcgatttagcacacgatagttgggtttgggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctcagactctcctgtgcaacctctggattcattttctctgacgcctggttgagctgggtccgccaggcctcccgggaagggctggagtgggttggccgtattaaaggtgaagacagtggtcgacaacagactaccagtgttcccgagaaaggcagnttcaactatctcaaagagatagactacaaaagaaatgaatatatctagacaaatgaaacaaactagaaaagcgaaggacacgaaggcgtagtaattacagtaaccanaagagtgggaccagatgacaaaagtcggaccgaacgacgacgttcgacgttacgacggggaccggaacgg

SEQ ID NO: 415883 - DNA, 572 bp, Homo sapiens
  misc_feature: GZ8MTXP02GZJZG.13.35.D02.1.454.CMB.2.raw
  modified_base (305)..(305): a, c, t, g, unknown or other
  modified_base (404)..(404): a, c, t, g, unknown or other
  modified_base (477)..(477): a, c, t, g, unknown or other
  modified_base (506)..(506): a, c, t, g, unknown or other
  modified_base (512)..(512): a, c, t, g, unknown or other
  modified_base (521)..(521): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagcgtggagttttcctcgctgctattttaaaaggtgtccagtgtgaggtgcaagtggtggagtcgtggggggggcttgggttaagccgtggggggtccctcagactctcctgtgcaacctctggattcattttctctgacgcctggttgagctgggtccnccaggctcccgggaagggctggagtgggtggccgtagttaaaggtagaagacagtggtcggacaacgagactaccagtcgttcccgtagaaacggcagnttcactatctacaaagagatgactacaaaagaaatgaatatatctagacaaatagaaacaacctagaaaacgngaagacacgagcgtagtatactgtaccanagtagnggacagganacgacgaacgcgacgaacgacgtacgtacgacgtacggacggggaccgacg

SEQ ID NO: 415884 - DNA, 588 bp, Homo sapiens
  misc_feature: GZ8MTXP02G008A.13.35.D02.1.454.CMB.2.raw
  modified_base (390)..(390): a, c, t, g, unknown or other
  modified_base (444)..(444): a, c, t, g, unknown or other
  modified_base (448)..(448): a, c, t, g, unknown or other
  modified_base (451)..(451): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctcagactctcctgtgcaacctctggattcattttctctgacgcctggttgagctgggtccgccaggcgtccgggaagggctggagtgggtgcgtataaaggtagaagacatggtacggacaacagactacagtgtccgtgaaaggcagnttcactatctcaaagagatagactacaaaaaagaaatagaattatatctagaanaaanaanaaacaaacaaagaaagaacgaagaacgaacgaagacgtacgtagtaacgtacgtaacaacgaacgacgtacggacgacgaagtacgacgaacgacggacgaacgacgacgtacgtacgtacggtacgggaccggacg

SEQ ID NO: 415885 - DNA, 642 bp, Homo sapiens
  misc_feature: GZ8MTXP02HNFPY.13.35.D02.1.454.CMB.2.raw
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtgggggtccctcagactctcctgtgcaacctctggattcattttctctgacgtcctggttgagcgtgggtccgccgaggccgtcccggggaaggggcgtggaggttgggtggccgttaagttaaaggtagaagacgagtggtcggaacaaacgagactaccgagtcgttcccgtagaaaggcaagactttcactatctacaagagatagaactaacaaaaagaaatagaattactaatctagaacaaaatacgaaaactaaaccgtagaaaaacgacgaaggaacaacgaggacgtagttattactacggtaacccaagtaagacgtcggggaccaaggactaggacaaaacgtcggacccgaacgaacggtacgttaccgaacgttaccggcgggggtaacccgggaacgg

SEQ ID NO: 415886 - DNA, 582 bp, Homo sapiens
  misc_feature: GZ8MTXP02F58WL.13.35.D02.1.454.CMB.2.raw
  modified_base (406)..(406): a, c, t, g, unknown or other
  modified_base (491)..(491): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctcagactctcctgtgcaacctctggattcattttctctgacgcctggttgagctgggtcccgccgaggcctccccggggaaggggctgggaggtgggtggccgtattaaaggtagaagacagtggtacggacaacagactaccagtcgtcccgtagaaaggcagntcactatctcaagagatgaactacaaaagaaatgaataatatactagacaaaatagaaacaaacctagaaaacgcgaaggaacanaacggcgtagtaacttactagtaaccatagatgggcagatgacaaagtggaccgcgacgtacgtacgacgtacgtcgggggacccggaacg

SEQ ID NO: 415887 - DNA, 605 bp, Homo sapiens
  misc_feature: GZ8MTXP02JEFNC.13.35.D02.1.454.CMB.2.raw
  modified_base (407)..(407): a, c, t, g, unknown or other
  modified_base (424)..(424): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcaacctctggattcattttctctgacgcctggttgagctgggtcccgccgaggcctcccggggaaggggcgtggaggtgggttggccgtaagttaaaggtagaagacagtggtcggacaacgagactaccgagtcgttcccgtagaaggcagnttcactatctacaaganatagactacaaaagaatgaatatatctagacaaatgaaacaacctaagaaacgcgaaagacaacgaggtacgtagttaacttactacggtaaccacgtaagacgtgggaccaaggatcgaccaaagtcggaccgaacggtaacgacgttcgaaccgtcggtaccgggggacccggtaaacg

SEQ ID NO: 415888 - DNA, 605 bp, Homo sapiens
  misc_feature: GZ8MTXP02I7RAP.13.35.D02.1.454.CMB.2.raw
  modified_base (274)..(274): a, c, t, g, unknown or other
  modified_base (408)..(408): a, c, t, g, unknown or other
  modified_base (511)..(511): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttggttaagccgtgggggtccctcagactctcctgtgcacctctggattcattttcnctgacgcctggttgagcgtgggtcccgccgaggccgtccccggggaaggggccgtggaggttgggttggaccgtaagttaaaggtagaaagacagtggtcggaacaacagactacagtcgtccgtagaagcagnttcactatctacaagagatagactaacaaaagaaatagataatatctagacaaatagaaaccaaactagaaaacgcgaagactaacgaggcgtagtattacgngtaaccagtacgagtacgggaccaagtaacacgaactaacgcggaccgaaggaccgtacggtacgtaaccgtacgggaccggggacccggaacg

SEQ ID NO: 415889 - DNA, 565 bp, Homo sapiens
  misc_feature: GZ8MTXP02JZXQV.13.35.D02.1.454.CMB.2.raw
  modified_base (395)..(395): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtctggggggggcttgggttaagcctggggggtccctcagactctcctgtgcaacctctggattcattttctctgacgcctggttgagctgggtccgccaggctccccgggaagggctggagtgggttggccgtattaaaggtagaagacatggtcggacaacagactaccagtgtcccgtgaaaggcagnttcactatctcaagagatgactacaaaagaaatgatatatctagacaaatgaaacaacctagaaaagcgaaggacacaggcgtagtattactgtaccacagaatcggggaccaggatgacaaaagtcggaccgcgacgagttcgacgtacgtcgggggcccggtaaacgg

SEQ ID NO: 415890 - DNA, 620 bp, Homo sapiens
  misc_feature: GZ8MTXP02GKB37.13.35.D02.1.454.CMB.2.raw
  modified_base (410)..(410): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggcttgggttaagccgtgggggtccctcagactctcctgtgcaacctctggattcattttctctgacgcctggttgagtcgtgggtcccgccgaggccgtccccggggaagggcgtgggaggttgggtggccgtaagttaaaggtagaagacagtggtacgacaagagactacgagtcgtaccgtagaaaggcagnttcaactatctacaagagatagactaacaaaagaaatagaataatatactagacaaatacgaaacaaaccgtaagaaaacgacgaaggacaacgtacggcgtagttaacttacgtagtaaccgaacgagtaagtcgggaccagtagtacgacgaaacgtcggacggaacgacggtacgtaccgacgttacggacggggacccggtaacgg

SEQ ID NO: 415891 - DNA, 546 bp, Homo sapiens
  misc_feature: GZ8MTXP02I2406.13.35.D02.1.454.CMB.2.raw
  modified_base (231)..(231): a, c, t, g, unknown or other
  modified_base (273)..(273): a, c, t, g, unknown or other
  modified_base (283)..(283): a, c, t, g, unknown or other
  modified_base (301)..(301): a, c, t, g, unknown or other
  modified_base (391)..(391): a, c, t, g, unknown or other
  modified_base (405)..(405): a, c, t, g, unknown or other
  modified_base (408)..(408): a, c, t, g, unknown or other
tcagtcacgtactacacgaccggtgctcgatttagcacacgatagttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttggccggcaagtcagancaattaccaactattgaattggtatacaaacaaaacaggganacgcccctanacctccttatctatggtncatccaacttacaaagtcgggtacccatcaaaggttcagtcggcactggatcgtagggcagtatttcactctacaccagtcagtcagtcngcaaactgaaattnttnactaacttagttatacgtacaatagtagttacagacgtacgtacgtacgacgaacggacgaaggtacgaaacaacgaaacgtagtacggtacgtactacgactaacgtagtactacgtaccttactacttacctaccg

SEQ ID NO: 415892 - DNA, 605 bp, Homo sapiens
  misc_feature: GZ8MTXP02H55BJ.13.35.D02.1.454.CMB.2.raw
  modified_base (404)..(404): a, c, t, g, unknown or other
  modified_base (421)..(421): a, c, t, g, unknown or other
tcagtcacgtactacacgaccggtgctcgatttagcacacgatagttgggtttggggggagaggagccccagccttgggattccccaagtgttttcattcagtgatcaggactgaacacagaggactcaccatggagtttgggctgagctggattttcctcgctgctattttaaaaggtgtccagtgtgaggtgcaagtggtgagtcgtgggggggcttggttaagccgtgggggtccctcagactctcctgtgcaacctctggtattcattttctctgacgcctggtgagcgtgggtcccgccgaggccgtacccggggaaggggctgggaggtggggttggccgtaagttaaaggtagaagacagtggcgaacaacgagactacagtgtcccgagaagcagntcgactatctacaaganatacgaactacaaaaagaaatagaatataatctagaacaaataagaaactaaaccgtagaaaaacgcgaagaccaagagacgtagtaattacgtacgtaaccacgaagtagtacgggacaagagtacgaacaaagtcggaccgaacgacgacgttaccgacgttaccggcggggacccggaacg

SEQ ID NO: 415893 - DNA, 707 bp, Homo sapiens
  misc_feature: GZ8MTXP02HCIV8.13.35.D02.1.454.CMB.2.raw
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaagtgcagctggtggagtcgtgggggaggcttggtacagcctggcaggtccctgagactctcctgtgcagccctctggtattcactttgatgattatgccatcgcctacgtcggggtcccggacaacggccgtaccggaaggggaacgggtcccgtaggggaggttcggggttctacgtaagggtaattaggagttagggtaaattagggtcggtagacgtaagttacggggcttaagtcggaccggtacttcgtaggttacgggaaacgggtccgtaacttaccgaaccctactacctacccgaagaacgaaacccgaaacgaccaaacgtaaaccctcccgtagtactcgtaacgaacctaaaagtacgaaaccgagtacccgtaggaacgaagtcgtaagggaacgaaccgtacggttccgtttagttaaacgttttacgtacgtaagtaaaacgaaaacgtaccttaaccccgtaaaaccctttaacgttaacgtttttacggaaggtttaacgg

SEQ ID NO: 415894 - DNA, 601 bp, Homo sapiens
  misc_feature: GZ8MTXP02H8A1X.13.35.D02.1.454.CMB.2.raw
  modified_base (419)..(419): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttgggttaagccgtgggggtccctcagactctcctgtgcaacctctggattcattttctctgacgcctggttgagcgtcgggtccgccaggccgtccccggggaggggctggagtgggtggccgtagtaaggtagagacagtggtcggacaacagactaccagtcgtcccgtagaagtcgagtattcgactatctacaagngatagactaacgaaaagaaatagaatatatactagacaaagtacgaaacaaacctaagaaaacggcgaagaacaacgaggtacgtagttaactacgtcgtaaccacaagtacgtaggaccacggtatagacaaacgtcggcgaacggacgtacgtcgacgtacggtcggggacccggtacgg

SEQ ID NO: 415895 - DNA, 662 bp, Homo sapiens
  misc_feature: GZ8MTXP02FK0L4.13.35.D02.1.454.CMB.2.raw
  modified_base (279)..(279): a, c, t, g, unknown or other
  modified_base (487)..(487): a, c, t, g, unknown or other
tcagtcacgtactacacgaccggtgctcgatttagcacacgatagttgggtttggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggaggtcgtggggggggtcttggttaagccgtgggggtccctcgagactctcctgtgcaacctctggattcattttcnctgacgcctggttgagcgtgggtcccgccagggccgtcccggggaaggggcgtgggagggtggggtttcggaccggttaagttaaagggtaaggaagtacgagttgggtaccggaacaaacgagtaactacgaggttcgtacccggtaggaaaaggcaagacttcgactatctagaaagagatagactaacaaaagtaatgaactatntatagacaaaagtacgaaaaccaaccgtaaggaaaacgcgaaagggaactacgaacgggtacgtagttacgtttacaagtacccaaagacgtaaggtcggaccgaacgatagaccaaaagtccggacgaacggacgtaacggttcggacgttaacggcgggggtaccccggaaag

SEQ ID NO: 415896 - DNA, 663 bp, Homo sapiens
  misc_feature: GZ8MTXP02G1EZY.13.35.D02.1.454.CMB.2.raw
  modified_base (398)..(398): a, c, t, g, unknown or other
  modified_base (416)..(416): a, c, t, g, unknown or other
  modified_base (434)..(434): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaggtgtccagtgtgaggtgcaagtggtggagtcgtggggggggcttggttaagccgtgggggtccctcagactctcctgtgcacctctgattctatttctctgacgtcctggttgagtcgtgggtcccgcgacggccgtacccggggaaggggcgtgggagggttggggttcggaccgttaagttaaaggtaggaagactagtggtacggacaacagactacgngtcgtccgtagaagcagnttcactactctacaaganatacgactaaagaaaagaatagaattaatactctaagaactaaagtaacgaaaactaacccgtaaaggaaaacggacgaaacggaaaccgaacgacgggtaccgttagttaacgtacgttacgaacccaagtagtaacggtacgggactaaggatacggactaaaggccggaccgtcggaaacgtacgttaccggacgtaccggggtaccgggggtaacccggtaacgg

SEQ ID NO: 415897 - DNA, 745 bp, Homo sapiens
  misc_feature: GZ8MTXP02FQHQX.13.35.D02.1.454.CMB.2.raw
  modified_base (256)..(256): a, c, t, g, unknown or other
tcagtcacgtactacacgaccggtgctcgatttagcacacgatagttgggtttgggggggagaggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtgggggggtcttggtaagccgtgggggtccctcgagactctcctgtncactctggattctatttctctgacgtccgtggttgacgtcgtgggtcccgcgacggccgtccggggagggcgtggaggtgggtcgacgtaagttaaaggtagaagacagtgggtacgaacaagacgtactaccgtagtcgtaccgtaggaaacgaccagtactcgacttagtacctaacgaaagagaactagaaactaaacgaaaaagtaaaatagtaaattaaactaattacgtaacgtaaacgtaaaaacgttaccgaaaaaccctaaacccggtaaaaaggaaaaccgggaacggaaacggggaaaacccctaaacgggaaaccgggttacgttaaggttaaaacctttaccggtaaccgtaaacccctaacgaaagtacggtacgggaaccgaagtaaacgacgaacgtaaaacgtcgggaacccgaacggaacgttaacggtaccgaaccggtaccgggtaccgggggaacccggtaaacccgg

SEQ ID NO: 415898 - DNA, 507 bp, Homo sapiens
  misc_feature: GZ8MTXP01EHJ7Z.3.72.G06.1.454.CMB.2.raw
  modified_base (201)..(201): a, c, t, g, unknown or other
  modified_base (293)..(293): a, c, t, g, unknown or other
  modified_base (352)..(352): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctccagatacaaccggagaaattgtgttgacacagtctccagccaccctgtctttgtctccaggggaaangccactctctcctgcagggccagtcagagtgttagcagctacttagcctggtaccagcagaacctggccaggctcccaggctcctcatttangatgcatccaacagggccactggcatcccagccaggttcagtggcagtggtctgggacngacttcactctcacatcagcagcctagagcctagaagtattttgactagtttattactgtctagcagcgtagcaactggcctctcaccgttcgggcggaagggaccaagggtcggagatacgaaacgacttaggtggctcgcaccatccttgtcc

SEQ ID NO: 415899 - DNA, 567 bp, Homo sapiens
  misc_feature: GZ8MTXP01ERL1S.3.72.G06.1.454.CMB.2.raw
  modified_base (202)..(202): a, c, t, g, unknown or other
  modified_base (293)..(293): a, c, t, g, unknown or other
  modified_base (305)..(305): a, c, t, g, unknown or other
  modified_base (352)..(352): a, c, t, g, unknown or other
  modified_base (367)..(367): a, c, t, g, unknown or other
  modified_base (371)..(372): a, c, t, g, unknown or other
  modified_base (394)..(394): a, c, t, g, unknown or other
  modified_base (545)..(545): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggctcccaggctctcatttangatgcatccaanagggccatggcatcccagccaggttcagtggcagtgggtctagggangtctcactctacacntcannacgtcagcgtcgtagtaagttntttcgattagtttaacttacgtgtacgagtacgacggtacgtacgaccgtaacgttcggtaccttctacccgtaccggttcggggacggggtaaacggaaccggttaagggtaggacgtaacgtaaacgaaaccgttagttggaacggtcncgaccaccttatcgttcgttcc

SEQ ID NO: 415900 - DNA, 496 bp, Homo sapiens
  misc_feature: GZ8MTXP01DDXYB.3.72.G06.1.454.CMB.2.raw
  modified_base (202)..(202): a, c, t, g, unknown or other
  modified_base (295)..(295): a, c, t, g, unknown or other
  modified_base (307)..(307): a, c, t, g, unknown or other
  modified_base (354)..(354): a, c, t, g, unknown or other
  modified_base (436)..(436): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccatctctcctgcagggccagtcagagtgttagcagctacttagcctggtaccagcagaaacctggccaggctcccaggctcctcatttangatgcatccaanagggccactggcatcccagccaggttcagtggcagtggtctgggacngacttcactctcaccatcagcagcctagagcctagaagattttgctagtttatactgtcagtcagcgtagcaactggccctntcaccttcggcggaaggccaagggtgagatcaaacgacttgtggctgcaccatcttgttc

SEQ ID NO: 415901 - DNA, 515 bp, Homo sapiens
  misc_feature: GZ8MTXP01EECJN.3.72.G06.1.454.CMB.2.raw
  modified_base (202)..(202): a, c, t, g, unknown or other
  modified_base (292)..(292): a, c, t, g, unknown or other
  modified_base (305)..(305): a, c, t, g, unknown or other
  modified_base (350)..(350): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccaccctgtctttgtctccaggggaaangccactctctcctgcagggccagtcagagtgttagcagctacttagcctggtaccagcagaacctggccaggctcccagctctcatttangatgcatccaaangggccatggcatcccagccaggttcagtggcagtggtctgggacngacttcactctcacatcagcagcctagacgcctagtaagtattttgactagtttattactgtcgagcagcgtagctaacgtcggcctctcaccgttcgggcgggaagggaccgaagggtggagaacgtacgaaacgttaacttggtggctgcacgactcttgttc

SEQ ID NO: 415902 - DNA, 651 bp, Homo sapiens
  misc_feature: GZ8MTXP01DY9OX.3.72.G06.1.454.CMB.2.raw
  modified_base (201)..(201): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccaggggaaanagccactctctcctgcgagggccagtcagagtgttagcagcttaacttagccgtcggtaccagcaacgaaaccgtggccaggcctcccagtcctcctcacttcgtttggcgcactccaggccgaccgggtcccctggcctaactcccgaagaccgtaggttcaggtcggactagggtcgggtctaggggaaacaggtcttcaaccttctaccaacctatacgacgacgagtacgtagggacgtaccgtaggtaaacgttagttttgacgtagttagttatttaacgttgtacggtaggttcttagttacggttactccgtaccgttcggttactacggttcgtttcgggaccggtaagggggaaccgtaaggggttggaagttaacgtaacgtaaacggttaacgttggttacgggtctacggccgtaactacttctcgttcctttaacg

SEQ ID NO: 415903 - DNA, 448 bp, Homo sapiens
  misc_feature: GZ8MTXP01BTYCN.3.72.G06.1.454.CMB.2.raw
  modified_base (440)..(448): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgctttgatatctggggccaagggacaatggtcaccgtctcttcagcctccaccaagggcccatcgtccttccccctggccaccctcctccaagcgcacctcgtcgggggcaacgacgcggccctggggctcgcctgggcaagctactccgagtcgcgtctcgtgagcgggctggcaaggcgcgatagnnnnnnnnn

SEQ ID NO: 415904 - DNA, 563 bp, Homo sapiens
  misc_feature: GZ8MTXP01CY9CU.3.72.G06.1.454.CMB.2.raw
  modified_base (201)..(201): a, c, t, g, unknown or other
  modified_base (294)..(294): a, c, t, g, unknown or other
  modified_base (365)..(365): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctccagatacaaccggagaaattgtgttgacacagtctccagccaccctgtctttgtctccaggggaaanagccactctctcctgcagggccagtcagagtgttagcagctacttagcctggtaccagcagaaacctgccaggctcccaggctcctcatttangatgcatcccaaacgacgggccacgtggcactcccagcctaggttcaggtggcaggtcgggtctagggacngtacttcactctcacatcagcagcctagacgtcctagaacgtatttcgacttagtttaattactgtacgagtcgtaagcgtagcctaacgtcggtaccctctcctaccgttcgggcgggaacgggaaccgaagggtggagtaacgtaacgaaaacgttacgttaggtcggcgtcgacctaccgttacttcgttcgttc

SEQ ID NO: 415905 - DNA, 666 bp, Homo sapiens
  misc_feature: GZ8MTXP01C9ZZE.3.72.G06.1.454.CMB.2.raw
  modified_base (200)..(200): a, c, t, g, unknown or other
  modified_base (291)..(291): a, c, t, g, unknown or other
  modified_base (640)..(640): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccaggggaangccactctctcctgcagggccagtcagagtgttagcagctacttagcctggtaccagcagaacctggccaggctccaggctcctcatttangatgcatcccaaacgagggcccacgtgggaccactccccgaagtcccgtagggtttccaggtcgggactagggttcggggtcgtagggggaactaaggtactttccgaccttcctaccaacctatcacgcaacgtaccgtaggacgtacccgtaaggtaaagttagttttacgactttaagttttacttaacgttcgttaccgagtacgtaacggtcggttaacggacctaacgttcggtaccctttccgtcccgtaacccggtttccggggaccggggtaaacggggaaccgttaaagggggttcggaacgtaacgttaacgaaaacggttcgttagggtaacggtcncggaccacgttacttcgttcgtttcc

SEQ ID NO: 415906 - DNA, 550 bp, Homo sapiens
  misc_feature: GZ8MTXP01CM465.3.72.G06.1.454.CMB.2.raw
  modified_base (203)..(203): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaaacctggccaggctcccaggctcctcatttatgatgcatccaaacagggccactggcatcccagccaggttcagtggcaggtggctagggacaagacttcactctcaccatcagcagcctagcgcctagaacgtatttgactagtttatacttgtacagtcagcgtagcaacgtgacctctcacgttcggcggtaagggaaccgaagggtcggaagtaacgtaccgaaaacggttacgttcggttaaggccgttcggaccaacccgttagttccttaacggtttcc

SEQ ID NO: 415907 - DNA, 631 bp, Homo sapiens
  misc_feature: GZ8MTXP01BHSK6.3.72.G06.1.454.CMB.2.raw
  modified_base (200)..(200): a, c, t, g, unknown or other
  modified_base (293)..(293): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgctccaggggaangccactctctcctgcagggccagtcagagtgttagcagctacttagcctggtaccagcagaaacctggccaggctcccaggctcctcatttangatgcactaccaacgacgggccacgtcggacacgtcccgagtccgtaggttcacggtcggacgtagggtcggggtcgtaacggggaactaaggtaccttccacttcctaccaacctatccacgacacgtaccgtaggacgtccgttaagtaagttattttcgacttagttttaattacgttgtacgtagtacgtacgtacgtacgactacgtcgtacccttcgtccgtaccggttcggggcgggtaacgggtaaccggttaaggggtacggaacgtaacgtaaccgaaaacggttcgttgggtcggctaacggacctaccgttacgttcgttcgttcc

SEQ ID NO: 415908 - DNA, 487 bp, Homo sapiens
  misc_feature: GZ8MTXP01A33T8.3.72.G06.1.454.CMB.2.raw
  modified_base (202)..(202): a, c, t, g, unknown or other
  modified_base (351)..(351): a, c, t, g, unknown or other
  modified_base (438)..(438): a, c, t, g, unknown or other
  modified_base (466)..(466): a, c, t, g, unknown or other
tcagagacgcactccacgaccggtgctcgatttagctacgactgcaagggaaaggggaggaactgctcagttaggacccagagggaaccatggaagcccagctcagcttctcttcctcctgctactctggctcccagatacaaccggagaaattgtgttgacacagtctccagccaccctgtctttgtctccaggggaaagngccactctctcctgcagggccagtcagagtgttagcagctacttagcctggtaccagcagaacctggccaggctcccaggctcctcatttatgatgcatccaacagggccatggcatcccagccaggtcagtggcagtggtctgggacngacttcactctcacatcagcagctagagctagaagtatttgctagttatactgtcagctgcgtagcactggcctctcacgttcgggnggaacggacaggtggagacgtcaaacgngttgtggctgcacatcttgtc

SEQ ID NO: 415909 - DNA, 562 bp, Homo sapiens
  misc_feature: GZ8MTXP01EPA0I.3.72.G06.1.454.CMB.2.raw
  modified_base (203)..(203): a, c, t, g, unknown or other
  modified_base (289)..(289): a, c, t, g, unknown or other
  modified_base (295)..(295): a, c, t, g, unknown or other
  modified_base (371)..(371): a, c, t, g, unknown or other
  modified_base (388)..(388): a, c, t, g, unknown or other
  modified_base (392)..(392): a, c, t, g, unknown or other
  modified_base (413)..(413): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccaccctgtctttgtctccgaggggaaangccactctctcctgcagggccagtcagagtgttagcagctacttagcctggtaccagcaagaacctggccaggctcccagctcctnatttangatgacataccaaacgagggcccactgaacactcccaagccaaggttccaggtggactaggtgggtcgtagggacngtacttcactctacacntcancagctagacgcctagaagttntttcgacttagtttatactgtacagtcagcgtagctaacgtcggcctcgtaccgtaccgttcgggcggaaacgggtccgaaaggggtcggaagaacgtaacgaaaacgttacgttggtcggactcgaccaccgttagttccttcgttcc

SEQ ID NO: 415910 - DNA, 577 bp, Homo sapiens
  misc_feature: GZ8MTXP01DTX3M.3.72.G06.1.454.CMB.2.raw
  modified_base (204)..(204): a, c, t, g, unknown or other
  modified_base (292)..(292): a, c, t, g, unknown or other
  modified_base (297)..(297): a, c, t, g, unknown or other
  modified_base (311)..(311): a, c, t, g, unknown or other
  modified_base (365)..(365): a, c, t, g, unknown or other
  modified_base (457)..(457): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctccagatacaaccggagaaattgtgttgacacagtctccagccaccctgtctttgtctccgaggggaaangccactctctcctgcagggccagtcagagtgttagcagctacttagcctggtaccagcaagaaacctggccaggctcccaggctcctnattangatgcatccaaagngggccagtggcactcccagccaggttcacggtggctaggtgggtctaggggacnggtaccttcaccttctaccaccatcagcagacctagacgtcctaggtaagtattttgacttaagtttattacgttgtacgagcgagtcgtancaacgtcggtacctcctccgtaaccgttcgggcgggaacgggacccgaaggggtaggagaacgtaacgaaaacggttacgttaggttcggcttcggaccctacgttactccgttgttccc

SEQ ID NO: 415911 - DNA, 571 bp, Homo sapiens
  misc_feature: GZ8MTXP01DX6KG.3.72.G06.1.454.CMB.2.raw
  modified_base (202)..(202): a, c, t, g, unknown or other
  modified_base (285)..(285): a, c, t, g, unknown or other
  modified_base (290)..(290): a, c, t, g, unknown or other
  modified_base (305)..(305): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccaggggaaangccactctctcctgcagggccagtcagagtgttagcagctacttagcctggtaccagcagaacctggccaggctccagctctnatttngatgcatcccaaagngggccagtggacactcccagccaggttcaggtggcaggtcgggtctaggggactggactttcactctcacatcagcagcctagacgctagaagtatttgacttagtttatacgtgtcgtaggttctagttcgttactctaccgttggttcagttcgtttcgggaccgtagggggtaacctaaggggttggtaacgaacgttaaccgaaaacggttacgttggttacggcgtacgaacctaacgtattccttaacgttccttaaccg

SEQ ID NO: 415912 - DNA, 595 bp, Homo sapiens
  misc_feature: GZ8MTXP01ENFT5.3.72.G06.1.454.CMB.2.raw
  modified_base (203)..(203): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccgaaggggaaangccactctctcctgcagggccagtcagagtgttagcagctacttagcctggtaccagcagaaacctggccaggctcccaggctcctcatctatgctgcatccaccgagggcccacgtggtactcccagccctagggttcaggtggctaggtcggggtctagggggactaaggtagtttcatttctacacctatccagcaggcctgcagttctagtaagtattttgacttaaatttattactgggtctaagctaagtaataaagtaacgtgggtacggtacggttcggaccgtaaaggggacctaaagggtaaacgaaagtaacgaaaacgtaacgtggttagggcttaggaaccaacctaacttcgtacgttaccttcgttaacgtttcccg

SEQ ID NO: 415913 - DNA, 552 bp, Homo sapiens
  misc_feature: GZ8MTXP01BIKQ9.3.72.G06.1.454.CMB.2.raw
  modified_base (201)..(201): a, c, t, g, unknown or other
  modified_base (285)..(285): a, c, t, g, unknown or other
  modified_base (291)..(291): a, c, t, g, unknown or other
  modified_base (358)..(358): a, c, t, g, unknown or other
  modified_base (391)..(391): a, c, t, g, unknown or other
  modified_base (399)..(399): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgctccaggggaaangccactctctcctgcagggccagtcagagtgtagcagctacttagcctggtaccagcagaacctggccaggctccaggctcctnatttangatgcatccaacgagggccacgtggcactcccagccaggttcagtggctaggtgggtctaggggacnggtacttcgactctcacatcagcagcctagacnctagagtntttgactagtttattactgtcagcagcgtagacctaacgtcggtaccctcgtcctaccggttcggggcgggtaacggggtaacccagggggttacggagtaacgtaccgaaaacggttacgttggaacggctggacccacacttcttcgttcc

SEQ ID NO: 415914 - DNA, 596 bp, Homo sapiens
  misc_feature: GZ8MTXP01CVGNC.3.72.G06.1.454.CMB.2.raw
  modified_base (203)..(203): a, c, t, g, unknown or other
  modified_base (360)..(360): a, c, t, g, unknown or other
  modified_base (372)..(372): a, c, t, g, unknown or other
  modified_base (441)..(441): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctactgcctggtaccagcagaaacctggcaggctcccaggctcctcatttatgatgcataccaacgagggccactggcactcccagccaggttcaggtggcaggtcgggtctagggacngtacttcactcncaccatcagcacgcctagacgcctagaacgttatttgacttagtttattacgtgtcagtcgtagcgtanccgaaacgtcggtaccctcctaccgtaccgttccgggacggggaacgggaacccgaaaggggttcggaacggtaaacgtaacccgttaaaaacgggttaccgttaggggtcgggacccttggaccccgtaccttaacgtttccgttcgtttcccg

SEQ ID NO: 415915 - DNA, 603 bp, Homo sapiens
  misc_feature: GZ8MTXP01BF1HJ.3.72.G06.1.454.CMB.2.raw
  modified_base (202)..(202): a, c, t, g, unknown or other
  modified_base (295)..(295): a, c, t, g, unknown or other
  modified_base (307)..(307): a, c, t, g, unknown or other
  modified_base (357)..(357): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaanagccactctctcctgcagggccagtcagagtgttagcagctattagcctggtaccagcagaaacctggccaggctcccaggctcctcatttangatgcatccaanagggccagtggcatcccagccaggttcaggtggcaggtgggtctgggacngtacttcactctacaccatcagcagcctaggacgcctagaagtattttacgacttaactttaacttactacgacctaaacttatttacgttacgttttcttaccgttccggttacgggtaccggtttccggaccgtaaaggggtaaccgaaagggttaacgggaaaacttacgaaaccgttaacgtggtcggacgttcggaccaaccgtatccggttacttccttactaaccttccgttaaccccg

SEQ ID NO: 415916 - DNA, 507 bp, Homo sapiens
  misc_feature: GZ8MTXP01ALX1S.3.72.G06.1.454.CMB.2.raw
  modified_base (202)..(202): a, c, t, g, unknown or other
  modified_base (295)..(295): a, c, t, g, unknown or other
  modified_base (307)..(307): a, c, t, g, unknown or other
  modified_base (354)..(354): a, c, t, g, unknown or other
  modified_base (365)..(365): a, c, t, g, unknown or other
  modified_base (423)..(423): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaacctggccaggctcccaggctcctcatttangatgcatccaanagggccactggcatcccagccaggttcagtggcagtggtctgggacngacttcactcncacatcagcagcctagagcctagaagtatttgctagtttattactgtcagcagcgtancgaactggcctctctaccgttcgggcgggaacgggaccgaagggtggaagagtacaaacgacttaggtgctgcaccatcttgtc

SEQ ID NO: 415917 - DNA, 762 bp, Homo sapiens
  misc_feature: GZ8MTXP01C6Y1G.3.72.G06.1.454.CMB.2.raw
  modified_base (202)..(202): a, c, t, g, unknown or other
  modified_base (297)..(297): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccgaggggaaangccactctctcctgcagggccagtcagagtgttagcagctacttagcctggtaccagcaagaacctggccaggctcccaggcctcctctatttangatgcatacccaaagacgggcccagtcgggcactccccaagtcccgtagggtttccaggttcgggacgtagggttcggggtacgtaaggggactggtacctttcgaaccttcctaccaacctatcccaacgcgaacgtacccgttaaggaccgtacccgttaaggtaaacgtttagtttttacggaaccgtttaaaggttttttaaactttaaccgttggttaacccggtaacgggtaccgttaaacggtaccgggttaacgaacccgtaaaccggtttccggggtacccctttacgttacccgtaccccggtttaccggggggaacggggtaaaccgggggtaaacccttaaaggggggttcggaaacggttaaccggtaaccgttaaaaaacccggggttacgttccggggttaacgggaccttccggaccgtaacccttagtttccgttaacggtttaaccc

SEQ ID NO: 415918 - DNA, 609 bp, Homo sapiens
  misc_feature: GZ8MTXP01BDDW0.3.72.G06.1.454.CMB.2.raw
  modified_base (203)..(203): a, c, t, g, unknown or other
  modified_base (296)..(296): a, c, t, g, unknown or other
  modified_base (362)..(362): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaaacctggccaggctcccaggctcctcatttangatgcatccagcacgggcccctggcactcccagacaggttcaggtggctaggtgggtctggggacnggtaccttcacttctcaccatcagcagactggacgctagaagtatttgactagtgtattactgggtcgtaggttctagttcggttactccgtaccgttcgggttctacgggttccgtttcgggcccggtaaggggggtaacccttaaagggggttaggaaacggtaaacgttaaccggaaaaacggttaccgttaggtaacggggtccttaagggacccaaccgttatttcccgttaaggttttccc

SEQ ID NO: 415919 - DNA, 483 bp, Homo sapiens
  misc_feature: GZ8MTXP01EBXOC.3.72.G06.1.454.CMB.2.raw
  modified_base (472)..(483): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctggtggggcagtaggtgggtactacctatgtcttttgatatcgtggggaccaagggacaaagtggtcaccgtctcttcacgccctccaccaacggcccagtccggtcccttcccccgtggccacccctcctccaagccgccactcgtcggggcaacgacgccggccctggggctcgcctggtacaacggactacgtccggagtcgcgtctcgtggacgcgggacgtggacgaaggcgacagtaggnnnnnnnnnnnn

SEQ ID NO: 415920 - DNA, 588 bp, Homo sapiens
  misc_feature: GZ8MTXP01EW5Z7.3.72.G06.1.454.CMB.2.raw
  modified_base (204)..(204): a, c, t, g, unknown or other
  modified_base (215)..(215): a, c, t, g, unknown or other
  modified_base (298)..(298): a, c, t, g, unknown or other
  modified_base (349)..(349): a, c, t, g, unknown or other
  modified_base (369)..(369): a, c, t, g, unknown or other
  modified_base (382)..(382): a, c, t, g, unknown or other
  modified_base (539)..(539): a, c, t, g, unknown or other
  modified_base (555)..(555): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgttctttgtctccgaggggaanagccactctcncctgcagggccagtcagagtgttagcagtctacttagcctggtaccagcagaacctggccaggctcccaggctcctcatttangatgcataccacagggcccagtggccactccccagccaggttcacggtggntaggtggggtctaggggacngtaccttcactcncaccatcacgcagcctagacgcctagaatattttgcttagtttaactacgtgtacgagtactaagtattaaagttaacgttgggtaggtaccggttacggaccgtaaacgggaaccgtaaaggggtaacaaacgttaacgaaacgttacgtagggtnaacgttcaccgtaacncttcgtcgttacttactaaccgttcccgtcccg

SEQ ID NO: 415921 - DNA, 556 bp, Homo sapiens
  misc_feature: GZ8MTXP01EY4Z3.3.72.G06.1.454.CMB.2.raw
  modified_base (203)..(203): a, c, t, g, unknown or other
  modified_base (294)..(294): a, c, t, g, unknown or other
  modified_base (359)..(359): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccaccctgtctttgtctccgaggggaaanagccactctctcctgcagggccagtcagagtgttagcagctacttagcctggtaccagcagaacctggccaggctcccagctcctcattangatgcatccaacgagggccacgtggcactcccagccaggttcagtggcaggtgggtctggggacnggtaccttcgactctcaccatcagcagcctagagcctagaagtattttgacttagtttattacgtgtcgagtcgaagcgtagcctaacgtcggccttctccgtacccgttcgggacgggaacggggaccttaaaggggtcggagaacgtacgaaacgttacgttggtcgggctggcacccgttatccgttgttaacc

SEQ ID NO: 415922 - DNA, 566 bp, Homo sapiens
  misc_feature: GZ8MTXP01A4LOS.3.72.G06.1.454.CMB.2.raw
  modified_base (204)..(204): a, c, t, g, unknown or other
  modified_base (293)..(293): a, c, t, g, unknown or other
  modified_base (307)..(307): a, c, t, g, unknown or other
  modified_base (428)..(428): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgttagcagctacttagcctggtaccagcagaacctggccaggctccaggctctcatttngatgcatccaacgngggccacgtgggaccacgtccccaagcccgtaaggttccaggtcggacgtaggttcggggtctagggggactggacctttcgacttctacaccatcagcacgcctagacgcctaggaattntttgcttagtttatacgtgtacagctagcgtagctaacgtcggcctcgtccgaccgttcgggcgggaagggaccgaggggtgacgacgtaacgaaacgttcgttgggtcgcgtaacgccgtacttatcccgttgttcc

SEQ ID NO: 415923 - DNA, 554 bp, Homo sapiens
  misc_feature: GZ8MTXP01BB37I.3.72.G06.1.454.CMB.2.raw
  modified_base (204)..(204): a, c, t, g, unknown or other
  modified_base (308)..(308): a, c, t, g, unknown or other
  modified_base (370)..(370): a, c, t, g, unknown or other
  modified_base (387)..(387): a, c, t, g, unknown or other
tcagagacgcactccacgaccggtgctcgatttagctacgactgcaagggaaagggggaggaactgctcagttagtacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgtagcagctacttagcctggtaccagcagaaacctggccaggctcccgagctcctcatttatgatgcatccaanacgggccacgtggccactccccgagcccagggttcaggttggctaggtgggtctaggggacnggtacttcactctcacntcagcagcctagacgccgtagaacgttatttcgcttagttttattactgtacagcagcgtagcgaactcggaccctcgtcctaccggttcgggcgggtaacgggaccgaaggggtcgacgtactaacgaaacgttcgttacggtggcgtcgccacgctcgttgttcc

SEQ ID NO: 415924 - DNA, 771 bp, Homo sapiens
  misc_feature: GZ8MTXP01ESVLL.3.72.G06.1.454.CMB.2.raw
  modified_base (201)..(201): a, c, t, g, unknown or other
  modified_base (250)..(250): a, c, t, g, unknown or other
  modified_base (300)..(300): a, c, t, g, unknown or other
  modified_base (305)..(305): a, c, t, g, unknown or other
  modified_base (324)..(324): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgctccaggggaaagngccactctctcctgcagggccagtcagagtgttagcagctacttagccntaggaccagacaagaacctggaccaggcctccgagtcctctactattatntatanacacacgaacgacggacgncaactacgacccgacgtacccgtaaacgtacccgtaacgggttacgaacggttacgggggtccggtacggggtacgggggtacgtaacggggttaaccgtaacgtaaccgtttaccgtaacccgtaaccttaccgtaacccgtaacgtaccgaaccggtaccgtaacgggtaacccgttaaccggtaaacgggtaaccggtttacggtttaacggttaacgtttttaacggtttaaccgtttaacggttttacgttaaccgttacggttacgtaacggtaaccgtaacgaaccgttaacggtacccgttaacccgttaccggttacccgttacccggttacccgggttaacccgggttacccggggttaaccggggtaacgggggtaaccgggtaaacgggttaacgggtaaacggttaaacggttaaccggttaaacggtaaccgg

SEQ ID NO: 415925 - DNA, 559 bp, Homo sapiens
  misc_feature: GZ8MTXP01CEMJ9.3.72.G06.1.454.CMB.2.raw
  modified_base (201)..(201): a, c, t, g, unknown or other
  modified_base (288)..(288): a, c, t, g, unknown or other
  modified_base (302)..(302): a, c, t, g, unknown or other
  modified_base (357)..(357): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctcgaggggaaangccactctctcctgcagggccagtcagagtgttagcagctacttagcctggaccagcagaacctggcaggctccagctctctattangatgcatccaacgnggccacgtggcactcccagccaggttcaggtggcgaggtcgggtctaaggggacngtacttcactcacaccatcagcacgctagcgcgtagaacgttatttgacgttagtttattacgtgttcgagtcgagtcgtagctaacgtcggcccttctccgtacccggttcggggacgggaagggaccgttaaggggtcgggaagtacgtaacgaaaacggttcgttggtcgggctcggaccacttacgttcgttcgttcc

SEQ ID NO: 415926 - DNA, 619 bp, Homo sapiens
  misc_feature: GZ8MTXP01D4SGT.3.72.G06.1.454.CMB.2.raw
  modified_base (204)..(204): a, c, t, g, unknown or other
  modified_base (296)..(296): a, c, t, g, unknown or other
  modified_base (303)..(303): a, c, t, g, unknown or other
  modified_base (321)..(321): a, c, t, g, unknown or other
  modified_base (397)..(397): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagttgtagcagcttacttagcctaggtaccagcaagaacctggccaggcctcccgaggcctcctntatttangatgcatacccgaaacgngggccagtcggacactccccagcctaggttcaggtcggcgtaggtgggtctaaggggactaaggtcttccacttcncaaccgatcagctagcctagacgcctagtaagttattttgacttaagtttattacgttgtacgagtcgaagtcgtaacgctaacgtcgtacccttcgtccgtaccggttcggggacgggtaaacgggtaaccgaaaggggttacgggaaagtaaacgtaacgaaaaccgggttcgttagggtaacggcgttaacgcctaaccttcgttccttaacggtttcc

SEQ ID NO: 415927 - DNA, 727 bp, Homo sapiens
  misc_feature: GZ8MTXP01B369Q.3.72.G06.1.454.CMB.2.raw
  modified_base (204)..(204): a, c, t, g, unknown or other
  modified_base (297)..(297): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctgtctcccagatacaaccggagaaattgtgttgacacagtctccagccacctgtctttgtctccgaggggaaancgccactctctcctgcagggccagtcaggtagtgttagcagtctacttagcctggaccagcagaacctggccaggctccaggctctctattangatgctactccaacgacgggcccacgtcggacctacgtccccgaggtacccgtagggttccgaaggttcgggactaggggttcggggtcgttacgggggaactaacggtacctttccaccttcctaccacccgtattaccacgaccgtaacggtccgtaagaccggtacccttaaggtaaacgtttgttttacggactttaacgttttactttaacgtggttacacggtacgtaacggtacggtaacgtacccgtaaccgttcgttaccccgtttacctacccggttacccgggtttacgggggaacccggggtaaacggggtaacccggttaaaaggggttcggaaacggtaacgtaaaccggaaaaaccggttcggttgggtaacggcgttaacgacccgttaccacgtttccgtttcgtttaacccg

SEQ ID NO: 415928 - DNA, 601 bp, Homo sapiens
  misc_feature: GZ8MTXP01CP8BJ.3.72.G06.1.454.CMB.2.raw
  modified_base (203)..(203): a, c, t, g, unknown or other
  modified_base (292)..(292): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggctccagctctcatttangatgcatccaacgcgggccagtcggcactcccagccgtaggtttccaggtcggcgtaggtcggggtctaaggggactggtactttccgacttctcaacctatcacgccaacgaccctaggacgtcccgtagtaacgttattttcgacttagtttaacttacgttcggtacagtacgagtacgtagacctaacgtcggcccttcgtaccgtccgttacgggcggtaacgggaacgttaagggtacggagttaaacgacgaaaaccgttagttcggtcggctcggaccctaccgttatcgttcgtttaacc

SEQ ID NO: 415929 - DNA, 690 bp, Homo sapiens
  misc_feature: GZ8MTXP01EPSLA.3.72.G06.1.454.CMB.2.raw
  modified_base (202)..(202): a, c, t, g, unknown or other
  modified_base (303)..(303): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgttctttgctcgaggggaangccatctctcctgcagggccagtcagtagttgttagcagtcttacttagcctaggtaccagcaagaacctggccaggcctcccgaggcctcctctatttangatcgcactacccgacgacggccacgtcggctacgtccccagcccgtagggtttcaagggtgggactaaggggttggggtacccgttaagggggaaccaacggttaccctttccaccgtttccctacaacccgtatccgaacgccaaacggtcccgtaagaccgtaccgtaaggttaaacgttttgtttacgtactttaagtttacttacgtacgttacgcgtacggtacggtcgtaacgtccgtaccgttccggtcccttaccgtacccggtacccgggttcggggaacggggtaacgggtaaccggttaaggggtacgaagtaacgtaaacgaacggttacgttcggtaacgtcgtaacgtaccacgttacttccgttcgttaac

SEQ ID NO: 415930 - DNA, 667 bp, Homo sapiens
  misc_feature: GZ8MTXP01BA0X8.3.72.G06.1.454.CMB.2.raw
  modified_base (203)..(203): a, c, t, g, unknown or other
  modified_base (294)..(294): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccgaggggaaangccatctctcctgcagggccagtcagagtgttagcagctacttagcctggaccagcaagaacctggccaggctcccaggctcctcatttangatgactactaccaacgcggccacgtcggactactcccgagccgtacggttacgacggttcggacgtagggtcggggtcgtaagggactaagtaccttcaccttctaccaacctatcgacgccgacgtaccgtaaggacgtaccgttaaggtaaacgtttagttttacggactttaagttttaacttacgttacgtacgtaacggtacgtaacggtacgtaacgaccgtaaccgttcggtaccccttccgtacccgtacccgggttccggggacggggtaacgggaaccggttaaaggggtacggaacgtaacgtaacgaaacggttcgttacgggtcggtccgtaacgaccctacgttacttcgttcgttcc

SEQ ID NO: 415931 - DNA, 642 bp, Homo sapiens
  misc_feature: GZ8MTXP01AWD5N.3.72.G06.1.454.CMB.2.raw
  modified_base (203)..(203): a, c, t, g, unknown or other
  modified_base (305)..(305): a, c, t, g, unknown or other
  modified_base (465)..(465): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctcgaggggaaangtcactctctcctgcagggccagtcagagttgttagcagtctacttacgcctggtaccagcaagaaacctggccaggcctacccgagtcctcctctatttangatgaccatacccaacgacgggccagtcggcactccccgagcccgtaggttcaggtggacgtagggttcgggtacgtaaggggacctaaggacctttccaactcctacacactcagcacggtcagacgcttagaagttatttgacttaagtttattacgngtacgagtacgtacggtacgtacgaccgtaaccgtcggtcccctccgtaccgtacccgggttcgggacgggggaacggtaacggttaaggggtacgaaaggtaacgtaaccgaaaccggttaagttcgggtaacgggccgttaacgacccaaacggttcttccgttaactttaaccg

SEQ ID NO: 415932 - DNA, 729 bp, Homo sapiens
  misc_feature: GZ8MTXP01CEIJ5.3.72.G06.1.454.CMB.2.raw
  modified_base (203)..(203): a, c, t, g, unknown or other
  modified_base (303)..(303): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccgaggggaaangccactctctcctgcagggccagtcagagtgttagcagcttacttagcctggtaccagcagaacctggccaggcctcccgaggtcctcctctattttagngatcgactacgtacccgaaacgcgggaccctacgtcgacctaccgtacccgagtaccgtaggttcgacggtcggacgtaggggtcggtacgtaacgggaactcggtaccttccgacttccaccgaacctataccgacgaccgtacggtaccgtaggaccgtaccgttaaggttaaacgtttagttttacgtaacgtttaacgttttaacttacgttcggtaacggtacggtacgtacggtaccggtaacgtacccgtaacggttccggtaccccttacgtacccggtacccgggttcgggggaaccggggtaaacggggtaacggttaggggtacggaaaccggtaaacgtaaccggttaaaacgggttcggttacgggtaacggtaccgtaacgacccgtaacgttacgtttccgttcgttaacc

SEQ ID NO: 415933 - DNA, 528 bp, Homo sapiens
  misc_feature: GZ8MTXP01BW23U.3.72.G06.1.454.CMB.2.raw
  modified_base (510)..(528): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctggtggggcagtaggtgggtactacctatgtcttttgatatcgtggggccaagggacaagtggtccaccgtctcttcacgccctccaccgaacgggcccctagttccggtccctttcccccgtggccctacccctccctaccgaaacgtccgcctacctcggtcgggggaccaacgacggccgggccctggggcctcggcccgttgggtacaagggtacccttacgttccggagtcgccgttctccgtggacggccgggcgtcgggcgaaggcccgaagagtgnnnnnnnnnnnnnnnnnnn

SEQ ID NO: 415934 - DNA, 642 bp, Homo sapiens
  misc_feature: GZ8MTXP01E0YIA.3.72.G06.1.454.CMB.2.raw
  modified_base (203)..(203): a, c, t, g, unknown or other
  modified_base (295)..(295): a, c, t, g, unknown or other
  modified_base (301)..(302): a, c, t, g, unknown or other
  modified_base (305)..(305): a, c, t, g, unknown or other
  modified_base (405)..(405): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccgaaggggaaancgccactctctcctgcgaggccagtcagtagtgttagcagcttaacttagcctggtaaccagacagaaacctggccaggctcccagctcctnatttannatnacacacgaacgcggcacgtcgacactccagtaccgtaggttcacggtcggacgtagggtcgggtcgtaacgggaactaacgtacctcacctccacactanacagacacgtacgagacgtacgtaagtaagtttagtttagagttaagtttattacgtacgtacggagacgtacgtacgtacgtacgtaccgtcgtaccctcgtaccgtaccggttcggggaacgggtaacgggaaaccggttaagggtaacggttaaacgtaaacgtaaccggttaaaacggttacggttcggtaacggtcctaacgacctaaccgttactttcgtttccgtttaac

SEQ ID NO: 415935 - DNA, 732 bp, Homo sapiens
  misc_feature: GZ8MTXP01EYY37.3.72.G06.1.454.CMB.2.raw
  modified_base (202)..(202): a, c, t, g, unknown or other
  modified_base (235)..(235): a, c, t, g, unknown or other
  modified_base (286)..(286): a, c, t, g, unknown or other
  modified_base (292)..(292): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgctccgaggggaaangccatctctcctgcagggccagtcagagtgtancagctacttagcctggtaccagcagaaacctggccaggctccaggctcctnatttanggatgacacttacccaacgacggggccccaacgtcggacctacgtacccccgaggtcccctaaggggtttccaagggttcggacgtaggggttggggtcccgtaagggggaacctaacggtaacctttccgacccttacctaccaaccctagtacccacggccaacggtaccccttaaggaaccgtcccgttaaaggtaaaggttttacgttttttacggaaccgtttaaggttttttaaactttaaccgttcggttaccgtaaacggtccgtaaagggtaccgttaacgaccgtaaaccgttcggtaccccttcgttacccgtaaccccggttcggggaacggggaacgggtaaccgttaaggggttcggaaacgtaacgtaaccgaaaacggttacttcgggtcggaccttggaccctaccgttatccgtttcgtccg

SEQ ID NO: 415936 - DNA, 665 bp, Homo sapiens
  misc_feature: GZ8MTXP01A9P72.3.72.G06.1.454.CMB.2.raw
  modified_base (203)..(203): a, c, t, g, unknown or other
  modified_base (304)..(304): a, c, t, g, unknown or other
  modified_base (511)..(511): a, c, t, g, unknown or other
  modified_base (620)..(620): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccgaggggaaangtcactctctcctgcagggccagtcagagttgttagcagctacgttagcctggtaaccagcaaggaaacctggccaggcctcccgaggcctcctctatttntgatgcactcccaaagtcgggccacgtcgggactactaccccgagtccgtagggttcaacggtcgggactagggtcggggttcgtaacggggaacctaaggtaccctttacaccttccgtacaccctagtccacgtacgacgtccgtaagaccgtccgttaaagtaacggtttattttcggacttaaggttttatacgtcgttacgngtactaacggtctaagacctaacgtcggtcccttctccgtaacccgggtttcgggacggggaaacgggtaccgaaggggtcggaacgtaacgtaacgaaaaccgggttnttcggggcggtatccggcgtaaaccttgttccgttaacggtttcc

SEQ ID NO: 415937 - DNA, 546 bp, Homo sapiens
  misc_feature: GZ8MTXP01A0K4T.3.72.G06.1.454.CMB.2.raw
  modified_base (141)..(141): a, c, t, g, unknown or other
  modified_base (264)..(264): a, c, t, g, unknown or other
  modified_base (518)..(518): a, c, t, g, unknown or other
  modified_base (520)..(546): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccgttcaccatctccaganacaattccaagaacacgctgtatctgacaaatgaacagcctgagagccgaggacacggcctatattactgtgcgagaggcaggtctggtgggctagtaggtggtactactatgtctttgatancgagggacaagggactaagtcggtctaccgtctcttcacgccctaccgaccgaacgggccctacgttccggtcccctttcccccgtcggcccctacccctcccgtaccgaacgccccgcccacgtcggcggggaccaaccgacggcccggcccgtgggcctcgtccgtaggtacgaacgtacgttaccgtcggtacgtcgtccgttcgtcggtacggtcggccgggacgtcgggacgaacggcgaacgagtagngnnnnnnnnnnnnnnnnnnnnnnnnnnn

SEQ ID NO: 415938 - DNA, 447 bp, Homo sapiens
  misc_feature: GZ8MTXP01CSZZF.3.72.G06.1.454.CMB.2.raw
  modified_base (437)..(447): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaaatgaacagcctgagagccgaggacacggccgtatattactgtgcgagaggcaggctgtggggcatagtgggtactactatgctttgatatctgggccaagggacaaatggtcaccgtctcttcagcctccaccaaggcccatcggtcttccccctggcacccctcctccaagacgcactcgtggggcaacagcgccctgggcctgcctggtcaaggactacgttccgagtgcgtctctgagcggggctggacaaggcgcgatagnnnnnnnnnnn

SEQ ID NO: 415939 - DNA, 502 bp, Homo sapiens
  misc_feature: GZ8MTXP02GWXYL.3.72.G06.1.454.CMB.2.raw
  modified_base (202)..(202): a, c, t, g, unknown or other
  modified_base (294)..(294): a, c, t, g, unknown or other
  modified_base (307)..(307): a, c, t, g, unknown or other
  modified_base (351)..(351): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggctcccaggctcctcatttangatgcatccaacngggccactggcatcccagccaggttcagtgcagtggctgggacngacttcactctcacatcagcagcctagagcctagagtatttgctagtttattactgtcagcagcgtagctaacgtcggcctcgtcctaccgttcggcggacggaccgagggtgagactacgaaacgacgtagaagcgtagcacatcgtgtc

SEQ ID NO: 415940 - DNA, 523 bp, Homo sapiens
  misc_feature: GZ8MTXP02IV71Z.3.72.G06.1.454.CMB.2.raw
  modified_base (295)..(295): a, c, t, g, unknown or other
  modified_base (307)..(307): a, c, t, g, unknown or other
  modified_base (340)..(340): a, c, t, g, unknown or other
  modified_base (347)..(347): a, c, t, g, unknown or other
  modified_base (353)..(353): a, c, t, g, unknown or other
  modified_base (364)..(364): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctccaggctcctcatttangatgcatccaanagggccactggcatcccagccaggttcagtgcngtgggtngggacngacttcactcncacatcagcagcctagacgcctagaagtattttgctagtttattactgtcagtcagcgtagctaacgtcggcctctccaccgttcgggacggtaacggggaccaaagggtggaaagtacgtacgaaaacgacgtgtaacggctagccacactctgttcc

SEQ ID NO: 415941 - DNA, 501 bp, Homo sapiens
  misc_feature: GZ8MTXP02F8A3W.3.72.G06.1.454.CMB.2.raw
  modified_base (202)..(202): a, c, t, g, unknown or other
  modified_base (295)..(295): a, c, t, g, unknown or other
  modified_base (354)..(354): a, c, t, g, unknown or other
  modified_base (436)..(436): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctactagcctggtaccagcagaaacctggccaggctcccaggctcctcatttangatgcatccaacagggccactggcatcccagccaggttcagtggcagtggtctgggacngacttcactctcaccatcagcagcctagagcctgaagtattttgctagtttattactgtcagcagcgtagcaactggcctcncaccttcggcggacgggaccaaggtggagactacgaaacgaactgtggctgacaccatctgttcc

SEQ ID NO: 415942 - DNA, 519 bp, Homo sapiens
  misc_feature: GZ8MTXP02HV10K.3.72.G06.1.454.CMB.2.raw
  modified_base (203)..(203): a, c, t, g, unknown or other
  modified_base (294)..(294): a, c, t, g, unknown or other
  modified_base (353)..(353): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaacctggccaggctcccagctctcatttangatgcatccaacaggccatggcatcccagccaggttcagtggcagtgggtctggggacngtcttcactcctcaccatcagcagcctagacgcctagacgtattttgctagtttacttactgtacagtcagcgtagacaacgtcggcctctcaccgttcggacggtacggaccgaagggtggacgactacgaaacgacgtagaacggctacgcactactcttcgtc

SEQ ID NO: 415943 - DNA, 510 bp, Homo sapiens
  misc_feature: GZ8MTXP02F769M.3.72.G06.1.454.CMB.2.raw
  modified_base (297)..(297): a, c, t, g, unknown or other
  modified_base (309)..(309): a, c, t, g, unknown or other
  modified_base (355)..(355): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttangatgcatccaangggccactggcatcccagccaggttcagtgcagtgggtctgggacngacttcactctcacatcagcagcctagacgcctagaagtatttgctagtttattactgtcagtcagcgtagcaactggcctcgtctaccgttcgggcggacgggaccgagggtcggaagactacgaaaacgactgtggctagcaccatctgttcc

SEQ ID NO: 415944 - DNA, 549 bp, Homo sapiens
  misc_feature: GZ8MTXP02I7YGZ.3.72.G06.1.454.CMB.2.raw
  modified_base (360)..(360): a, c, t, g, unknown or other
  modified_base (389)..(389): a, c, t, g, unknown or other
  modified_base (540)..(540): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttagggccattagcctggtaccagcagaaacctggccagcctccagtctcctcatctatggagcacacaacaggccactggcatcccagccaggtcagtgcagtggctgggacagacttcacctnatcatcagcccgctagacgcctagaagtnttttgacttagtttattacgtgttacagtcgagggttacttcgtggtcccctacgtttcggcccgttagggaaccctaaaggtgtaactacgtacaaaacggtactaggtggactcggactaccatctagtccttcacttccgttaccccnctactctag

SEQ ID NO: 415945 - DNA, 522 bp, Homo sapiens
  misc_feature: GZ8MTXP02JVKYC.3.72.G06.1.454.CMB.2.raw
  modified_base (292)..(292): a, c, t, g, unknown or other
  modified_base (305)..(305): a, c, t, g, unknown or other
  modified_base (346)..(346): a, c, t, g, unknown or other
  modified_base (352)..(352): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaacctgccaggctccaggctctcatttngatgcatccaacngggccactggcatcccagccaggttcagtggcagtgggtcngggacngcttcactctcaccatcagcagcctagacgcctagaacgtattttgacttagtttattactgtcagcagcgtagctacgtcggcctctcctaccgttcgggacggtacgggaccgagggtcggagacgtacgaaacgacgtggtggcgtacggcaccgattactcgttcc

SEQ ID NO: 415946 - DNA, 523 bp, Homo sapiens
  misc_feature: GZ8MTXP02JKSK3.3.72.G06.1.454.CMB.2.raw
  modified_base (202)..(202): a, c, t, g, unknown or other
  modified_base (294)..(294): a, c, t, g, unknown or other
  modified_base (307)..(307): a, c, t, g, unknown or other
  modified_base (357)..(357): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgtagcagctacttagcctggtaccagcagaacctggccaggctcccaggctcctcatttangatgcatccaacngggccactggcactcccagccaggttcaggtggcaggtggtctggggacngacttcactctcacatcagcagcctagacgcctagaagtatttgactagtttacttattgtcagcagcgtagcaacgtgcctctcaccgttcggacggacgggacgaagggtcggaagactacgaaacggtaactggtaacggcgtacgccgacctatctacgttc

SEQ ID NO: 415947 - DNA, 585 bp, Homo sapiens
  misc_feature: GZ8MTXP02HK119.3.72.G06.1.454.CMB.2.raw
  modified_base (201)..(201): a, c, t, g, unknown or other
  modified_base (266)..(266): a, c, t, g, unknown or other
  modified_base (272)..(272): a, c, t, g, unknown or other
  modified_base (287)..(287): a, c, t, g, unknown or other
  modified_base (299)..(299): a, c, t, g, unknown or other
  modified_base (343)..(343): a, c, t, g, unknown or other
  modified_base (349)..(349): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccaggggaaanagccactctctcctgcagggccagtcagagtgttagcagctacttagcctggtaccagcagaacngcagcnccagctctcatttangatgcatccaanagggccatggcatccccagccaggttcagtggctaggtgggtcngggacngcttcaccttctacacatcagcagcctagacgcctagaacgttagttttcgacgttagttttaattaaccgtttggtacctagtacaggtcggttaacgcgtaaaccgtcgggtcccttctaccgtacccgttcgggaccgggaacgggacccgtaaaggggtcggaaagtacttaaccgaaaacggtaccgtagggtaacgacgtacggacctaacgtacttccgtttaggtccc

SEQ ID NO: 415948 - DNA, 437 bp, Homo sapiens
  misc_feature: GZ8MTXP02H8D3R.3.72.G06.1.454.CMB.2.raw
  modified_base (432)..(437): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgcttttgatatctggggccaagggacaatggtcaccgtctcttcagcctccaccaaggccatcggtcttccccctggcacccctcctccagacgcacctctggggcacagcggccctgggctgcctggtcaaggactacttcccgagtgcgtctctgagcgggctggcaaggcgcatagnnnnnn

SEQ ID NO: 415949 - DNA, 542 bp, Homo sapiens
  misc_feature: GZ8MTXP02GXI4K.3.72.G06.1.454.CMB.2.raw
  modified_base (203)..(203): a, c, t, g, unknown or other
  modified_base (290)..(290): a, c, t, g, unknown or other
  modified_base (296)..(296): a, c, t, g, unknown or other
  modified_base (356)..(356): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgtagcagctacttagcctggtaccagcaagaacctggccaggcctcccaggctcctnatttangatgcatccaacgagggccactggcatcccagccaggttcagtgcaggtggtctgggacngcttcactctcacatcagcagcctagacgcctagaagtattttgactagtttattactgtacagtcagtcgtagacgtaacgtcggtacctcgtaccgtaccgttcgggacgggtaacgggtaccgaaggggtcggaaggaactacgaaaacgtacgtgtaacggctacgacacctatcgtattcc

SEQ ID NO: 415950 - DNA, 509 bp, Homo sapiens
  misc_feature: GZ8MTXP02J11O5.3.72.G06.1.454.CMB.2.raw
  modified_base (202)..(202): a, c, t, g, unknown or other
  modified_base (294)..(294): a, c, t, g, unknown or other
  modified_base (354)..(354): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaanagccactctctcctgcagggccagtcagagtgttagcagctattagcctggtaccagcagaacctggccaggctcccaggctcctcatttangatgcatccaacagggccactggcactcccagccaggtcagtggcaggtggtctgggacngacttcactctcaccatcagcagcctagacgcctagagtattttgctagtttattactgtcagcagcgtagcactgcctctcaccgttcgggcggacggaccgaaggtcggagacgtacgaaacgaactgtaaggctcgcaccgactcctgttcc

SEQ ID NO: 415951 - DNA, 559 bp, Homo sapiens
  misc_feature: GZ8MTXP02IGBLP.3.72.G06.1.454.CMB.2.raw
  modified_base (202)..(202): a, c, t, g, unknown or other
  modified_base (306)..(306): a, c, t, g, unknown or other
  modified_base (355)..(355): a, c, t, g, unknown or other
  modified_base (376)..(376): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccaggggaaangccactctctcctgcagggccagtcagagtgttagcagctacttagcctggtaccagcagaacctggccaggctcccaggctcctcatttatgatgcatccaangggccactggcatcccagccaggttcaggtgcaggtgggtctggggacngtacttcactcctcacatcancagcctagacgcctagaacgtattttgcttagtttattactgtcagtcagtcgtagctaacgtcggtaccttctccgtaccgttccgggacggtacggggaccgtaaaggggtcgaacggtactaacgaaaaccgtacgtacggtaacggcgttacggccaacccgtattccgtcgtttaccg

SEQ ID NO: 415952 - DNA, 553 bp, Homo sapiens
  misc_feature: GZ8MTXP02JUQZL.3.72.G06.1.454.CMB.2.raw
  modified_base (202)..(202): a, c, t, g, unknown or other
  modified_base (293)..(293): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgtagcagctacttagcctggtaccagcagaacctggccaggctcccaggctcctcatttangatgcatccaacgaggccagtggcatcccagccaggttcagtggcaggtgggtctggggacaggtacttcaccttctacaccatccagctaagccctagagtcctagaagtattttgacttagtttatactgtacagcagcgtagctacgtcggcctcgtcgtaccgttcgggcggtaacgggaccgaaagggtcggaaagtacgtaaccgaaacggtaacgttggtaacggccttaggccaaccgtacttctcgtttcc

SEQ ID NO: 415953 - DNA, 512 bp, Homo sapiens
  misc_feature: GZ8MTXP02IQ6ZD.3.72.G06.1.454.CMB.2.raw
  modified_base (201)..(201): a, c, t, g, unknown or other
  modified_base (292)..(292): a, c, t, g, unknown or other
  modified_base (348)..(348): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccagggaaangccactctctcctgcagggccagtcagagtgttagcagctacttagcctggtaccagcagaacctggccaggctcccaggctctcatttangatgcatccaacaggccatggcatcccagccaggttcagtgcagtggtctgggacngtacttcactctcaccatcagcagcctagacgcctagaatatttgacttagtttattactgtcagtcagcgtagacactggacctctcctaccgttcggacggacgggacaagggtcggagtactacgaaaacgtactaggtcgactcgacacactctagttcc

SEQ ID NO: 415954 - DNA, 692 bp, Homo sapiens
  misc_feature: GZ8MTXP02JQA6D.3.72.G06.1.454.CMB.2.raw
  modified_base (203)..(203): a, c, t, g, unknown or other
  modified_base (288)..(288): a, c, t, g, unknown or other
  modified_base (294)..(294): a, c, t, g, unknown or other
  modified_base (298)..(298): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgtagcagctacttagcctggtaccagcagaacctgccaggctcccaggctcctnatttangatncataccaagcggccagtcgcactccgagccgtaggttcaggtcggacgtaggtcggggtcgtaggggactacggtaccttaccgaccttcctaccaacctataccgaacgccaacgtacccgtaaggacgtacccgtaaggtaaacgtttagttttacgactttaagttttaactttaacgttgtaccgtacgtacgtagggtaccgtaacgtaccgtaacggttccggtaccccttacgttacccgtacccgggttacggggaccgggggtaaaccgggtaacccggtaaagggggtacgggaaacgtaaaccgtaaccgaaaaaccggttacgttacgggtaaccggtaccgtacggacccgtaaccgtacgttacccgttacgtttacccg

SEQ ID NO: 415955 - DNA, 615 bp, Homo sapiens
  misc_feature: GZ8MTXP02G4OVG.3.72.G06.1.454.CMB.2.raw
  modified_base (203)..(203): a, c, t, g, unknown or other
  modified_base (296)..(296): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggttcccaggcctcctcatttangatgcatccaacgaggggcctaacgtggaccatccccgagccctaagggttcaggtcggctaggtcggggtctggggacaggtccttcactcacctaccatcagcagacgtggacgcctgaaacgttgtttgcgtagttagttatttaacgtgttacaggttactagttcgggttaacctccgtaccgttcggttactagttcgtttacgggccgtacgggggacctaaggggttggaacgtacgtaacgtaaaaccggtaacgttcgggtacggtaacgtacggaccgtacctagtttccgttacggttacctttccg

SEQ ID NO: 415956 - DNA, 664 bp, Homo sapiens
  misc_feature: GZ8MTXP02GR6NP.3.72.G06.1.454.CMB.2.raw
  modified_base (203)..(203): a, c, t, g, unknown or other
  modified_base (238)..(238): a, c, t, g, unknown or other
  modified_base (295)..(295): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttancagctacttagcctggtaccagcagaacctggccaggctcccaggctcctcatttangatgcactccaacgacggccacgtcggacactccccgagccgtaaggttcacggtcggcgtagggtcggggtcgtaggggaacaggtaccttcaccttcctaccaacctataccgacgacacgtaccgtaagacgtaccgttagtaaacgttagtttacgacgttaagttttacttacgtgttacgacgtcgacgtacggtaacgacgtaacgttcggtacccttaccgtaccgttacccgggttaccggggaaccggggtaaacgggtaaccggtaaaggggtacgggaaacgtaaacgtaaaccgaaaacggtaacgttacggtaacggtacgtacgaccgtaaccgtacgttccgttacgtttacc

SEQ ID NO: 415957 - DNA, 526 bp, Homo sapiens
  misc_feature: GZ8MTXP02FL8WO.3.72.G06.1.454.CMB.2.raw
  modified_base (203)..(203): a, c, t, g, unknown or other
  modified_base (297)..(297): a, c, t, g, unknown or other
  modified_base (354)..(354): a, c, t, g, unknown or other
  modified_base (360)..(360): a, c, t, g, unknown or other
  modified_base (366)..(366): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaaacctggccaggctcccaggctcctcatttangatgcatccaacagggccactgggcatccccagccaggttcagtggcaggtgggtcngggacngacttnactctcacatcagcagcctagagcctagaagtatttgactagtttattactgtcagcagcgtagcaacgtggcctctcaccgttcgggcggtacgggaccgagggtcggagaacgtacgaaaacgacgtggtaaggctacggacacctactctcgtttcc

SEQ ID NO: 415958 - DNA, 536 bp, Homo sapiens
  misc_feature: GZ8MTXP02GWF9C.3.72.G06.1.454.CMB.2.raw
  modified_base (203)..(203): a, c, t, g, unknown or other
  modified_base (295)..(295): a, c, t, g, unknown or other
  modified_base (358)..(358): a, c, t, g, unknown or other
  modified_base (373)..(373): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaacctggccaggctcccaggctcctcatttangatgcatccaacagggccacgtggcatccccagccaggttcagtggcagtgggtctggggacngacttcactctcacntcagcagcctagacgcctagaagtattttgactagtttattactgtacagtcagtcgtagctaactcggacctctccaccgttcgggacggtaacgggaccgaagggtcggaagtacgtacgaaaacgtaacgtcggtggctacggacaccgatctagtttcc

SEQ ID NO: 415959 - DNA, 574 bp, Homo sapiens
  misc_feature: GZ8MTXP02FQPCH.3.72.G06.1.454.CMB.2.raw
  modified_base (202)..(202): a, c, t, g, unknown or other
  modified_base (309)..(309): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaanagccactctctcctgcagggccagtcagagtgttagcagctactagcctggtaccagcagaaacctggccaggctcccaggcctcctcatctatgatgcatccaagngggccactggcactccccagccctaggttcccagtcgcgtaggtgggtctggggacagaccttcactctacaccatcagcagcctagagccgtagaagtagttttcgacttagttttacttacgttcgtcgagctaggtacgtaacgctaacgtcggtcccttcgtaccgtaccggtttcgggacgggtacggggaccgtaaaggggtcggaacgtaacgtaacgaaaacggtaacgtcggtggacgtcgacacctacgtcttcg

SEQ ID NO: 415960 - DNA, 532 bp, Homo sapiens
  misc_feature: GZ8MTXP02I76M6.3.72.G06.1.454.CMB.2.raw
  modified_base (201)..(201): a, c, t, g, unknown or other
  modified_base (295)..(295): a, c, t, g, unknown or other
  modified_base (307)..(307): a, c, t, g, unknown or other
  modified_base (350)..(350): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaanagccactctctcctgcagggccagtcagagtgttagcagctacttagcctggtaccagcagaaacctggccaggctcccaggctcctcatttangatgcatccaanagggccactggcatcccagccaggtcagtgcagtggctgggcngcttcactctcacatcagcagcctagacgtcctagaacgtattttgacgtagtttacttactgttacagtcagcgtaagcaacgttggcctcgtctaccgttcgggacggacgggaccgaagggtggaacgtagtaccgaaaacgtactacggtaagccgtagaccacgtactcgtcgttac

SEQ ID NO: 415961 - DNA, 594 bp, Homo sapiens
  misc_feature: GZ8MTXP02IMG8J.3.72.G06.1.454.CMB.2.raw
  modified_base (201)..(201): a, c, t, g, unknown or other
  modified_base (289)..(289): a, c, t, g, unknown or other
  modified_base (295)..(295): a, c, t, g, unknown or other
  modified_base (470)..(470): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgctccaggggaaangccactctctcctgcagggccagtcagagtgttagcagctacttagcctggtaccagcagaaacctggccaggctcccaggcctcctnatttangatgcatcccaaacgcgggccacgtcgggccaactccccaagccctagggttccaggttcggcctagggttcggggtctaggggacacggtactttcgacctctaccacatcagcacgcctaagacgtcctagaagttattttgacttagtttattactgttcagtcagtcgtanacaacgtcggtcctacgtctacccggtgggacgggtaacgggaccgaaggggtcgaaacgtaacgtaaccgaaaacgtacgttggtaacggactacggaccaacgtacttccgtacgtttaccg

SEQ ID NO: 415962 - DNA, 518 bp, Homo sapiens
  misc_feature: GZ8MTXP02FUXWW.3.72.G06.1.454.CMB.2.raw
  modified_base (202)..(202): a, c, t, g, unknown or other
  modified_base (295)..(295): a, c, t, g, unknown or other
  modified_base (353)..(353): a, c, t, g, unknown or other
  modified_base (406)..(406): a, c, t, g, unknown or other
  modified_base (425)..(425): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaangccactctctcctgcagggccagtcagagtgttagcagctacttagcctggtaccagcagaaacctggccaggctcccaggctcctcatttangatgcatccaacaggccacgtggcatcccagcctaggtcagtgcagtggtctgggacngactcactctcacatcacgcagcctagacgcctagagtattttgactagtttnttactgtacagcagcgtancgaatgcctctcaccgtcggacggacggaccgaagggtcgagtacgtacgaaaacgacgtaggtcggactacgaccacctagtactcgtttcc

SEQ ID NO: 415963 - DNA, 661 bp, Homo sapiens
  misc_feature: GZ8MTXP02FS6QE.3.72.G06.1.454.CMB.2.raw
  modified_base (201)..(201): a, c, t, g, unknown or other
  modified_base (294)..(294): a, c, t, g, unknown or other
tcagagacgcactccacgaccggtgctcgatttagctacgactgcaagggaaagggggaggaactgctcagttgggacccagagggaaccatggaagccccagctcagcttctcttcctcctgctactctggctcccagatacaaccggagaaattgtgttgacacagtctccagccaccctgtctttgctccaggggaangccactctctcctgcagggccagtcagagtgttagcagctacttagcctggtaccagcagaaacctggccaggcctccaggctcctcatttangatgcatacccaacgagggcccagtcgggaccactccccgaagcctaaggttcaggtggactaggtcgggtctaggggacaggtaccttcactcctaccaacctatcaagcacgtccctaaggacgtacccgtagaagttattttgacctttaagttttacgttaccgttaggttaccaaggtccgtaaggtaccggttaagacccgtaacgttccgggtaccctttaccgtaccgtaacccgtttcgggggaaccgggtaaccggggaaccgtaaggggttacggaaacgtaacgttaaccgaaaaccggtaccgttagggtaacggtaccttacggaccctaccgtactttccgtacgtttaccc

SEQ ID NO: 415964 - DNA, 458 bp, Homo sapiens
  misc_feature: GZ8MTXP02IXQZF.3.72.G06.1.454.CMB.2.raw
  modified_base (443)..(458): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcagtagtgggtactacctatgcttttgatatctggggccaagggacaatggtcaccgtctctttcagcctccaccaagggcccatccggtccttccccctggccacccctcctaccagacgcacctcgtggggcacagcggcctgggctgcctggtcaaaggactacttccgagtcgcgtctctgagtcgggctggcaaggcgacatagnnnnnnnnnnnnnnnn

SEQ ID NO: 415965 - DNA, 531 bp, Homo sapiens
  misc_feature: GZ8MTXP02GOWYK.3.72.G06.1.454.CMB.2.raw
  modified_base (202)..(202): a, c, t, g, unknown or other
  modified_base (261)..(261): a, c, t, g, unknown or other
  modified_base (283)..(283): a, c, t, g, unknown or other
  modified_base (348)..(348): a, c, t, g, unknown or other
  modified_base (409)..(409): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccaccctgtctttgtctccaggggaaanagccactctctcctgcagggccagtcagagtgtagcagctatagcctgacagcagaacnggcagctccagctctcatttangatgcatccaacagggccacgtggacactcccagccaggttcagtggcaggtgggtctagggacngacttcactctcacatcagcagcctagacgcctagaacgtatttgactagtttatactgtnagcagctagcaagtcggacctctccgtaccgtcgggacggacgggacccgaaagggtggaaacgtacgtacgaaaaacgtacgtagtaacggcctaggacctaaccgtatccctagtttccc

SEQ ID NO: 415966 - DNA, 499 bp, Homo sapiens
  misc_feature: GZ8MTXP02FS4EO.3.72.G06.1.454.CMB.2.raw
  modified_base (202)..(202): a, c, t, g, unknown or other
  modified_base (355)..(355): a, c, t, g, unknown or other
  modified_base (482)..(482): a, c, t, g, unknown or other
  modified_base (485)..(485): a, c, t, g, unknown or other
  modified_base (497)..(497): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaaacctggccaggctcccaggctcctcatttatgatgcatccaacagggccactggcatcccagccaggttcagtgcagtgggtctgggacngacttcactctcacatcagcagcctagagcctgaagtattttgctagtttattactgtcagcagcgtagcaactggcctctcaccttcggcggacgggaccaagggtgagatacaaaacgaactggngcncgacacactctntc

SEQ ID NO: 415967 - DNA, 440 bp, Homo sapiens
  misc_feature: GZ8MTXP02GYAQ8.3.72.G06.1.454.CMB.2.raw
  modified_base (433)..(440): a, c, t, g, unknown or other
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggctgtggggcatagtgggtactacctatgctttgatatctggggccaaggggacaatggtcaccgtctcttcagcctccaccaaggcccatcggtcttccccctggcaccctcctccaagacgcacctctcggggcacagcggccctgggctgcctggtcaaggactacttccgagtgcgtctctgagcgggctggcaaggcgcatagnnnnnnnn

SEQ ID NO: 415968 - DNA, 486 bp, Homo sapiens
  misc_feature: GZ8MTXP02HHCZ9.3.72.G06.1.454.CMB.2.raw
  modified_base (202)..(202): a, c, t, g, unknown or other
  modified_base (289)..(289): a, c, t, g, unknown or other
  modified_base (420)..(420): a, c, t, g, unknown or other
  modified_base (428)..(428): a, c, t, g, unknown or other
  modified_base (432)..(432): a, c, t, g, unknown or other
  modified_base (468)..(468): a, c, t, g, unknown or other
  modified_base (470)..(470): a, c, t, g, unknown or other
  modified_base (473)..(473): a, c, t, g, unknown or other
  modified_base (481)..(481): a, c, t, g, unknown or other
  modified_base (484)..(484): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaactggcagctccagctcctcattangatgcatccaaacagggccactggcatcccagccaggttcagtggctaggtgggtctgggacagacttcactctacaccatccagcagcctagagcctagaagattttgactagtttatactgtcagcagngagacacncgcnctctacgtcgcggacggacgagagagacacaacgangngcncgcacacnctntc

SEQ ID NO: 415969 - DNA, 656 bp, Homo sapiens
  misc_feature: GZ8MTXP02JVHIO.3.72.G06.1.454.CMB.2.raw
  modified_base (203)..(203): a, c, t, g, unknown or other
  modified_base (293)..(293): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctattagcctggtaccagcagaacctggccaggctccaggctcctcatttangatgcactaccaacgacggccacgtcggacactccccgagccgtaggttcacggtcggacgtaggttcggggtcgtaggggaactacgtacctttcaccttcctaccaacctagtccgaacgccgacgtaccctaaggacgtaccgtagtaaacgttattttacgtacttaagttttaacttacgttgtacgagtacgtaggtacgttaacgacctaacggtcggtcccttcgtacccgtacccggttcggggaccgggtaacggggaaccgtaaggggtacggaaacgtaacgtaaccgaaaacggtaacgttgggtaacggtaccgtacggacctaaccgtacgttaccgttacgttaccc

SEQ ID NO: 415970 - DNA, 548 bp, Homo sapiens
  misc_feature: GZ8MTXP02JQF73.3.72.G06.1.454.CMB.2.raw
  modified_base (200)..(200): a, c, t, g, unknown or other
  modified_base (285)..(285): a, c, t, g, unknown or other
  modified_base (291)..(291): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgctccaggggaaangccactctctcctgcagggccagtcagagtgttagcagctattagcctggaccagcagaacctggccaggctcccgaggctcctnatttangatgcatccaaacaggccacgtggcatcccagcccaggttcaggtgcaggtgggtctaggggacaggacttcaccttctacaccatcagcagcctagacgcctagaagtattttagcttagtttattactgtcagctagcgtagactaacgtcgtcctctcaccgttcgggacggaacgggaccgtaaaggggcggaaagaacgtaacgaaaaccgtacgtaggtcggacgtacggaccacctatcgttacgtttcc

SEQ ID NO: 415971 - DNA, 526 bp, Homo sapiens
  misc_feature: GZ8MTXP02FFFYW.3.72.G06.1.454.CMB.2.raw
  modified_base (202)..(202): a, c, t, g, unknown or other
  modified_base (359)..(359): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaangccactctctcctgcagggccagtcagagtgttagcagctacttagcctggtaccagcagaaacctggccaggctccccaggctcctcatctatgctgcatccaccagggccactggtatccccagccaggttcagtgtcagtggggtctggggacngagttcattctcacatcagcagcctgcagtctgaagattttgactaatttattactagtcagctagtataataactggtggacgttcggacaagggaccaaaggtagaaatacaaaacgaaacgtgtacggctagaacgaccaactctagttcttactacttacccg

SEQ ID NO: 415972 - DNA, 648 bp, Homo sapiens
  misc_feature: GZ8MTXP02JQ2U4.3.72.G06.1.454.CMB.2.raw
  modified_base (202)..(202): a, c, t, g, unknown or other
  modified_base (294)..(294): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccaccctgtctttgtctccaggggaaangccactctctcctgcagggccagtcagagtgttagcagctattagcctggtaccagcagaaacctggccaggctcccaggctcctcatttangatgcactccaacgcgggccagtcggcacgtccccagccctagggttcacggttggctaggtggggtcgtggggaccaggtacctttcaccttcctcaaccctatccagccaacggtccctaaggacgcccgtaggtaaacgttatttttaggaccttaggttttaatttacgtgttaccaggtaccgaaggtccgtagacctaaaccgttcgggacccttcgtaccgtacccggtttccggggaccgggggttaacggggtaaacccgaaggggttacgggaaacgtacgtaaccgaaaacggtacgttagggtaacggacgtacgaccgtaccctagtccgttacgtttccc

SEQ ID NO: 415973 - DNA, 561 bp, Homo sapiens
  misc_feature: GZ8MTXP02I3VRM.3.72.G06.1.454.CMB.2.raw
  modified_base (203)..(203): a, c, t, g, unknown or other
  modified_base (296)..(296): a, c, t, g, unknown or other
  modified_base (357)..(357): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccgaggggaaangccatctctcctgcagggccagtcagagtgttagcagctacttagcctggtaccagcagaaacctggccaggctcccaggcctcctcatttangatgcatccaacgagggccactggcatcccagccaggttcagtgcaggtgggtctgggacnggtacttcactcctcacatcacgtcacgcctaagcgccctagaacgttattttggacttagtttattacgtgttacagtcaggcgttaagacaacgtcggtaccctctacctaccgttcgggacggtacgggaccgtaagggtcggaaggtactaacgaaacgtactggtaagtcgtacggaccacgtactcgttacgtttacc

SEQ ID NO: 415974 - DNA, 541 bp, Homo sapiens
  misc_feature: GZ8MTXP02JPKNE.3.72.G06.1.454.CMB.2.raw
  modified_base (202)..(202): a, c, t, g, unknown or other
  modified_base (288)..(288): a, c, t, g, unknown or other
  modified_base (294)..(294): a, c, t, g, unknown or other
  modified_base (305)..(305): a, c, t, g, unknown or other
  modified_base (351)..(351): a, c, t, g, unknown or other
  modified_base (382)..(382): a, c, t, g, unknown or other
  modified_base (429)..(429): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccaggggaaangccactctctcctgcagggccagtcagagtgtagcagctacttagcctggtaccagcagaaacctggccaggctcccaggctcctnatttangatgcatcaanggccagtggcatcccgagccaggttcagtgcagtgggtctgggacngtcttcactctacacatcagcacgcctagcncctgaagtattttcgacttagtttacttactgtacagtcagtcgtancgaactggacccttgtacctaccggttcggacgggaacgggaccgtaaaggggtcgagaacgttacgaaaaccggagttgtaacggactacggacacctagttctcgttacc

SEQ ID NO: 415975 - DNA, 674 bp, Homo sapiens
  misc_feature: GZ8MTXP02JD1FZ.3.72.G06.1.454.CMB.2.raw
  modified_base (293)..(293): a, c, t, g, unknown or other
  modified_base (301)..(301): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaagcgccactctctcctgcagggccagtcagagtgtagcagctatagcctagtaccagcaagaacctggccaggcctcccgaggtcctcctntatttagngatcgactactaccaacgagggcctacgtcgacacgtccccgagccgtaaggttcgaacggtcggacgtaggggtcggggtacgtacggggaacctacgggttaccttaccctaccgttaccgtaaccccgaaccttacgtacccgaacgacccgaaccggtacccgtaacgggacgtacccgtaagtaacggttagtttttacgacgtttagtttacttaccgtgttaaccgagtaccgtaggtaccgttacgacgtaacgtcggtaccctacgtacctaccggtgggaccgggaacggtaaccgtaggggtacggaataaccgtaacgaaacgtagtcggtcggactacgacctactacttcgtgttaccc

SEQ ID NO: 415976 - DNA, 713 bp, Homo sapiens
  misc_feature: GZ8MTXP02JX2Q4.3.72.G06.1.454.CMB.2.raw
  modified_base (202)..(202): a, c, t, g, unknown or other
  modified_base (289)..(289): a, c, t, g, unknown or other
  modified_base (297)..(297): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaanagtcactctctcctgcagggccagtcagagtgttagcagctattagcctggtaccagcagaacctggccaggcctcccaggcctccnctatttangatgcatcccaaacgagggccaacgtgggaccactcccccagccctagggttcaggtggacagggttcgggtcgtaggggactaggtacctttcaaccttctaccaaccctagttacccagacccaacggtccctaagggacgtacccgtaggtaaaacgttacgtttttacggacctttaaggtttttaaactttaaccgttggtttacccgaaggtacctaagggtccggttaaagaccctaaaccggttccgggtaccccttcgttaccccgttacccggtttccgggggaccgggttaacgggggaacccggtaaagggggttcgggaaacggtacgttaaaccgaaaaccggtaaaccgttgggtaacggtacgttacggaccctaccgtagtttaccgttcgtttacccg

SEQ ID NO: 415977 - DNA, 542 bp, Homo sapiens
  misc_feature: GZ8MTXP02GQ57J.3.72.G06.1.454.CMB.2.raw
  modified_base (203)..(203): a, c, t, g, unknown or other
  modified_base (295)..(295): a, c, t, g, unknown or other
  modified_base (307)..(307): a, c, t, g, unknown or other
  modified_base (353)..(353): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaacctggccaggctcccagctcctcatttangatgcatccaanggccactggcactcccagccaggttcagtgcagtgggtctgggacngcttcactctcaccatcagcagcctagacgtcctagaatatttgacttagtttattactgtcagtcagcgtagaccaacgtcggcctcgtcctacccgtttcggggacggaacggggaccgtaaggggtcggaagacgtacgaaaacggtactaggtaacggctacggctacacttccgtacgtttacc

SEQ ID NO: 415978 - DNA, 602 bp, Homo sapiens
  misc_feature: GZ8MTXP02JDUL3.3.72.G06.1.454.CMB.2.raw
  modified_base (203)..(203): a, c, t, g, unknown or other
  modified_base (286)..(286): a, c, t, g, unknown or other
  modified_base (292)..(292): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcaggccagtcagagtgtagcagctacttagcctggtaccagcagaacctggccaggctccaggcctctnatttangatgcatacccaacgagggccaacgtcggccacgtccccgaagtcccgtaaggttccaggttgggacctaggtcggggtctaggggactaggtaccttcgaccttctaccacctatccacgtcacgcctaagacgtcccgtagaagtattttcgacttagtttattacgtgtacagcgagtcgtacgacgtaacgtcggcctctccgtaccgttacggccggacgggaaccgtaggggtacggtaacgtacgtaacgaaaaccgtacgtacggtaacggcgtacgactaccgtactccgttacgtttacc

SEQ ID NO: 415979 - DNA, 656 bp, Homo sapiens
  misc_feature: GZ8MTXP02HNTRP.3.72.G06.1.454.CMB.2.raw
  modified_base (204)..(204): a, c, t, g, unknown or other
  modified_base (290)..(290): a, c, t, g, unknown or other
  modified_base (295)..(295): a, c, t, g, unknown or other
  modified_base (308)..(308): a, c, t, g, unknown or other
  modified_base (430)..(430): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaanagccactctctcctgcagggccagtcagagtgttagcagcttactagcctggtaccagcagaacctggccaggctccaggctcctnattangatgctatccaancggccagtggacactcccagccgtaggttccaggtcggcgtaggtcggggtcgtacggggactcggtacctttcgacctctaccaccatccagcacgtcctagacgtccgtagtaaacgttntttacgacgtttagtttacttacgttgttactaacggtcgtaacgtacggttacgaccgtaaccgttcgggtaccctttaccgaccgttacccgggttcggggaaccgggggtaaccggggtaacccggtaaagggggtacggaaacggtaaccgtaacgggaaaaccgttaaccggtgggtaacggtacgtacggtaccgaaccgtctttccgttcgtttacccg

SEQ ID NO: 415980 - DNA, 654 bp, Homo sapiens
  misc_feature: GZ8MTXP02ICBDM.3.72.G06.1.454.CMB.2.raw
  modified_base (204)..(204): a, c, t, g, unknown or other
  modified_base (301)..(301): a, c, t, g, unknown or other
  modified_base (318)..(318): a, c, t, g, unknown or other
  modified_base (334)..(334): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgttagcagtctacttagcctggtaccagcagaaacctggaccaggcctcccaggcctcctcatttangatgcactcccaaccgngggcccaaccggtacncccagcccgtaggttcaggtggccctaggtggggtctaggggactaggacgtttccaccgttctaccaccgtatccgagccacgtctgactagttcagtagttattttgacttagtttactacttgttacagtacttattaacgtaaacttaacgtcggtaccgttcggtaccttcgttaccggtttccggggacgggtaacggggtaaccgtaaagggggttggtaaacgttaacgaaaccggtaaaacgtaaccggttgggtacgggtaacgttacggaccgtaaacctacgtttcccgttacggtttcctttaaccg

SEQ ID NO: 415981 - DNA, 637 bp, Homo sapiens
  misc_feature: GZ8MTXP02HH0NM.3.72.G06.1.454.CMB.2.raw
  modified_base (204)..(204): a, c, t, g, unknown or other
  modified_base (311)..(311): a, c, t, g, unknown or other
  modified_base (362)..(362): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgtagcagctacttgcctggtaccagcagaacctggccaggcctacccaggctcctcatttatgatgactatccaangggccagtggaccatccccagccaggttcaggtcggactagggtggggtcnggggacaggtcctttcacttcctccaacacgttcacgcacggccctaaggacgtcccgtagaacgtacgtttttacgaaccttaaactttaccgttaattaggttaccaaacggtaacggtccttagggaacctacggttcccttacccggtcttaccgtaccgttttcggggacggggaacggggtaaccgaagggggttaggtaacggaacgtaaccaaaacggtacgttaggtcggaacctggaaccgtacccattccggttacttacctac

SEQ ID NO: 415982 - DNA, 579 bp, Homo sapiens
  misc_feature: GZ8MTXP02JXL5I.3.72.G06.1.454.CMB.2.raw
  modified_base (203)..(203): a, c, t, g, unknown or other
  modified_base (298)..(298): a, c, t, g, unknown or other
  modified_base (313)..(313): a, c, t, g, unknown or other
  modified_base (382)..(382): a, c, t, g, unknown or other
  modified_base (397)..(397): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccatctctcctgcagggccagtcagagtgtagcagctacttagcctggtaccagcaagaacctggccaggcctcccaggcctcctctatttangatgcatccaaacgngggccacgtgggccactccccgaagtccgagggtttcacggtggactagggttcggggtctaggggacnggtaccttcacttcnccacatcacgcaagcccgtagacgtcctagaagttattttacgactaactttactattcgtaccaagtggtacacgtacacgttccgtacccgtctactccgtttcgggacggtacgggtaccgaagggtgaacggactaacgaaacgtacgtgtacggctcgacacgtatcgtacgtcttc

SEQ ID NO: 415983 - DNA, 664 bp, Homo sapiens
  misc_feature: GZ8MTXP02JI8BT.3.72.G06.1.454.CMB.2.raw
  modified_base (204)..(204): a, c, t, g, unknown or other
  modified_base (302)..(302): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgtagcagctacttagcctggtaccagacagaaacctgaccaggcctcccgaggcctcctctatttagngatgacctatacccgaaacgcgggacctacgtggacctaacgtcccccgagtaccccgtaagggtttccaacggggttcggacgaggttcggggtacgtggggaactacggtacttccaaccgttcctacccaactataccgagtacccgacggtaccctaaggaccgtccgtagaacgttattttcggaccttagttttaacttacgtagttaccgagccgtagtaccggtaataccgtacgtccgtcctacgtaccggtaccggtacggggacggtaacgggaacgtaaggggtacgaaagtaaccgtaacgaaaacggtggtacggtaacggcgtacgacctacgtacgttcttacgtc

SEQ ID NO: 415984 - DNA, 568 bp, Homo sapiens
  misc_feature: GZ8MTXP02FIGR0.3.72.G06.1.454.CMB.2.raw
  modified_base (202)..(202): a, c, t, g, unknown or other
  modified_base (298)..(298): a, c, t, g, unknown or other
  modified_base (312)..(312): a, c, t, g, unknown or other
  modified_base (360)..(360): a, c, t, g, unknown or other
  modified_base (391)..(391): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccaggggaaanagccactctctcctgcagggccagtcagagtgttagcagctacttagcctggtaccagcagaaacctggccaggctcccaggcctcctctatttangatgcatccaacgnggcccatggcactcccagccaggttcagtgcaggtgggtctggggacngactcactctcaccatcagcacgcctagacnccgtagaagttatttggacttagtttacttacgtgtcacgcaggtcgtagacctaacgtcggcccttcgtccgtaccgtttcggggacgggtaacgggacccgaaggggtacggaaggtaactaaccgaaaacgacgttaggtcggacgtacggacctaccgtactcgtcgtttacc

SEQ ID NO: 415985 - DNA, 630 bp, Homo sapiens
  misc_feature: GZ8MTXP02HKQ5N.3.72.G06.1.454.CMB.2.raw
  modified_base (199)..(199): a, c, t, g, unknown or other
  modified_base (299)..(299): a, c, t, g, unknown or other
  modified_base (336)..(336): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaattgtgttgacacagtctcagccaccctgtctttgtctccaggggaanagccactctctcctgcagggccagtcagagtgttagcagctattagcctaggtaccagcaagaacctggaccaggcctcccaggcctcctctattttagngtatcgacactaccgaacgcggccacgtcgactaccncccgagtaccgtaggtcgacggtcggacgtagggtcggtcgacgggactcgtacttacacctcctacaccataccgagtacgacgtcgtagcgtacgtagtagttagtttcgtattagtttacttacgtgtacgtgtacgtaggtacgtacgtaccgtacgtcgtaccttcgtaccgtacgggtaccggggacgggtaaccgggaacggtaggggtaacggtaacgtaacgtaaaacgaacggtaacggtcggtaacggtaccgtacgaccgtactcgttaccttgtttacccg

SEQ ID NO: 415986 - DNA, 632 bp, Homo sapiens
  misc_feature: GZ8MTXP02IATN0.3.72.G06.1.454.CMB.2.raw
  modified_base (204)..(204): a, c, t, g, unknown or other
  modified_base (284)..(284): a, c, t, g, unknown or other
  modified_base (291)..(291): a, c, t, g, unknown or other
  modified_base (305)..(305): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaaggggaaangccactctctcctgcagggccagtcagagtgttagcagctattagcctggtaccagcagaacctgccaggctccagctcnctattangatgcatccaacgngggccacgtggacatcccagccaggttcaggtggctaggtcggggtctggggactggtacctttcaccttcctcaaccatccacgcacgcctaagacgcctaggtaacgttattttggacttagtttaattacgttgttacaggtacgtagtacggttagacctaaacgttcggtcccttaccgttaccgtacccgtttacggggacggggtaacggggaaccggtaaacgggggttagggaaacggtaaacgttaaccgaaaaacgggtaaccgttagggtaacggtacgtacggacctaaccgtacttccgtttacggtttcccg

SEQ ID NO: 415987 - DNA, 657 bp, Homo sapiens
  misc_feature: GZ8MTXP02JSG94.3.72.G06.1.454.CMB.2.raw
  modified_base (204)..(204): a, c, t, g, unknown or other
  modified_base (232)..(232): a, c, t, g, unknown or other
  modified_base (238)..(238): a, c, t, g, unknown or other
  modified_base (277)..(277): a, c, t, g, unknown or other
  modified_base (291)..(291): a, c, t, g, unknown or other
  modified_base (297)..(297): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagngtgtancagctattagcctggtaccagcagaaacctggccaggcncccgaggcctcctnatttangatgactataccaaacgacgggccaacgtcggaccactccccgaagcccgtaggttcacggttggacctaggggtcgggtacgtaggggaaccaggtacctttacgacctttccaccaccgtactccgaagtccacggtaccctaagacggcccttaagaacgttagttttgaccttaagttttaactaccgtgttaccgagtacgtaacggtacgtaacgacctaaaccggttcgtacccttccgtaccgtaccgggttacgggacgggtaacggaccgtaaaggggtcggtaagtaacgtaaccgaaaacgtacgtggtaacgacgtacgacccgtaacgcgttacgtacgtttaccc

SEQ ID NO: 415988 - DNA, 682 bp, Homo sapiens
  misc_feature: GZ8MTXP02HPYHL.3.72.G06.1.454.CMB.2.raw
  modified_base (202)..(202): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccgaggggaaanagccactctctcctgcagggccagtcagagtgttagcagctatagcctggtaccagcagaactggccaggctccaggctcctcatctatgctgcactcccaacgacggggcccacgttacggtactacccccaggccccgtaaggggtttccaagggttcgggacgtacggggttggggtcgtacggggaactaggggttacgtttacactttccaccaacccgtatcccgacggtccaacggtcccgttgaccgtaggttacttaagggtaaagtttatttttacgactttaaagtttttacttacgttgttacgtaagtactaagttaataacgttaacgttggggtacgtacggttaccggacgaaaaggtaccgaaaagggtaacaaactaaaccgaaaacggttacgtgggtacgacgttacgaaccgtaacctagtttacccggttacgtttaccctttacgtacctttccccg

SEQ ID NO: 415989 - DNA, 604 bp, Homo sapiens
  misc_feature: GZ8MTXP02JX7MM.3.72.G06.1.454.CMB.2.raw
  modified_base (203)..(203): a, c, t, g, unknown or other
  modified_base (297)..(297): a, c, t, g, unknown or other
  modified_base (387)..(387): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaanagccactctctcctgcagggccagtcagagtgttagcagctacttagcctggtaccagcagaacctggccaggctccaggcctcctctatttangatgacatccaacgagggccaacgtgggacactccccgaagtcccctaaggtttccaagggtggaccgtaggttggggtctaggggaacnggtacctttcgaccttctacccaaccgtatcacgcaacgacccgtagacgtacctaggaagttattttgacttagtttacttacgtgtacagtcgagtcgtagacacgtcggccttactccgtacccgtcggggacccgtaacggggaccgaagggtcggaacactacgaaaaccgtacgtcggtaacggctacggacacctacgtccgtgtttacc

SEQ ID NO: 415990 - DNA, 667 bp, Homo sapiens
  misc_feature: GZ8MTXP02I5C1E.3.72.G06.1.454.CMB.2.raw
  modified_base (202)..(202): a, c, t, g, unknown or other
  modified_base (281)..(281): a, c, t, g, unknown or other
  modified_base (287)..(288): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaangccatctctcctgcagggccagtcagagtgttagcagctattagcctggtaccagcagaacctgccagctccagctctnatttannatgcataccaagcggccagtcgacactccgagccgtaggttcacggtcggacgtacggggttcggggtacgtacggggaacctacggttacctttaccgaacccgttcctaacccgaacctagttaccgaacgaccaacggtaccgtaacggtaacgtaccgtaggtaaagtttacgttttacggtacgtttaagttttaactttacgttcgttacgacgtacgtaacggtacgtaacgaccgtaacggtcgtacccttacgttacccgtaccggttcgggaccgggtaacgggaccggtaagggtacggaacgtaacgtaaccgaaaacggtacgttacggaacgtacgtacgacctacgtcgttccgttacgttacc

SEQ ID NO: 415991 - DNA, 577 bp, Homo sapiens
  misc_feature: GZ8MTXP02H9F7D.3.72.G06.1.454.CMB.2.raw
  modified_base (201)..(201): a, c, t, g, unknown or other
  modified_base (298)..(298): a, c, t, g, unknown or other
  modified_base (364)..(364): a, c, t, g, unknown or other
  modified_base (381)..(381): a, c, t, g, unknown or other
  modified_base (411)..(411): a, c, t, g, unknown or other
  modified_base (452)..(452): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccaggggaanagccactctctcctgcagggccagtcagagtgttagcagctacttagcctggtaccagacacgaaacctggccaggcctccgaggctccatatttangatgcatcccaagcgggcccacgtggcactcccgagccaggttcagtggcaggtgggtctgggacngtctcactcctcactancacgcacgacctagcgtacctagaacgttnttttcgactagttttattacgtagtcgtagcgtagcgtaancgaacgtcggtcctctcgtaccgttcgggcgggtaacgggaccgaagggtcggaaagtacgtaaccgaaaacggtactacggtaacggaccgttacggaccaacctacgttccgtacgtttaccg

SEQ ID NO: 415992 - DNA, 607 bp, Homo sapiens
  misc_feature: GZ8MTXP02F7ML6.3.72.G06.1.454.CMB.2.raw
  modified_base (201)..(201): a, c, t, g, unknown or other
  modified_base (301)..(301): a, c, t, g, unknown or other
  modified_base (571)..(571): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctccagatacaaccggagaaattgtgttgacacagtctccagccaccctgtctttgctcgaggggaangccactctctcctgcagggccagtcagagtgtagcagcttacttagcctggtaccagacagaaacctggaccaggcctcccgaggcctcctactatttangatgcataccaacgcggccagtcgacactcccagcctaggttcaggtcgcgaggtcggggtctaggggactagtaccttcgactcctaccacctatccgaaagcacgtacccgtaagaccgacgttagaagttattttacgacttaaacgttacttattacgacaaacgtggtcctaggacctacgtccctaccgtcttacgtaccggttacggggacggggaacgtaccgaaggggtcgaaacgtaacgtaaccgaaaacgttaccggnggtacgaacgtacgactacgtattcgtacttctacg

SEQ ID NO: 415993 - DNA, 747 bp, Homo sapiens
  misc_feature: GZ8MTXP02HDH1N.3.72.G06.1.454.CMB.2.raw
  modified_base (203)..(203): a, c, t, g, unknown or other
  modified_base (267)..(267): a, c, t, g, unknown or other
  modified_base (294)..(294): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctccagatacaaccggagaaattgtgttgacacagtctccagccacctgtctttgtctccgaggggaaangccactctctctgcagggccagtcagagtgttagcagctattagcctggtaccagcaagaaccnggccaggcctccgaggctctcatttangatgacaactccaaaacgaggggccccacgtggaccaacgtccccgaaggtccaagggtttcaagggtcggacgtagggttcggggttacgtacggggaacacggtacctttacgaacctttacccgtacctaaaaccccgaattaccgaaacgtacccgtaaaccgggtaccctaaggggaaacccgtcccgttaaaggtaaaacgtttaagttttttacgggaaccgttttaaaggtttttaaaactttaccgtttaggttaaaccgtagttacgaaacggtcggttaaacgaccgttaaaaccgttcggggtaccctttccgttacccgtacccgggtttacggggaaccgggggacgggttaaaacccgaaggggttacggaacgtaaacgtaaccgaaaaccggtagtagggtcggaccttagacctaacgtcttccgttagttcccg

SEQ ID NO: 415994 - DNA, 669 bp, Homo sapiens
  misc_feature: GZ8MTXP02IYJ7D.3.72.G06.1.454.CMB.2.raw
  modified_base (201)..(201): a, c, t, g, unknown or other
  modified_base (263)..(263): a, c, t, g, unknown or other
  modified_base (283)..(283): a, c, t, g, unknown or other
  modified_base (290)..(290): a, c, t, g, unknown or other
  modified_base (305)..(305): a, c, t, g, unknown or other
  modified_base (310)..(310): a, c, t, g, unknown or other
  modified_base (359)..(359): a, c, t, g, unknown or other
  modified_base (496)..(496): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgtctccgaggggaangccactctctcctgcaggccagtcagagtgtagcagctatagcctggtaccagcacgaaccngaccaggcctccagcctctntatttangatgcataccaacgnggccncgtgcactcccagcctaggttcaggtgcgtaggtcgggtatacgggacnggtaccttcgaccttccgtaccaacctactaccgaacgtccgaacggtacccgtaggaccgtaccgtaagggtaactttacgttttacgaaacctttaaacgtttaacctttaagttccggtaaacctaaaaccggngggttacctacgggtaaccttacgttcccgtacccggtcttaccgttaccggtttccgggacgggtaaaccgggacgtaaaggggtacggaacgaacgttaaaccgaaacggtaacgtcggttacggccttaacggacctaacccgttagtttccgttacgtttccgttaacc

SEQ ID NO: 415995 - DNA, 782 bp, Homo sapiens
  misc_feature: GZ8MTXP02J0FYV.3.72.G06.1.454.CMB.2.raw
  modified_base (203)..(203): a, c, t, g, unknown or other
  modified_base (259)..(259): a, c, t, g, unknown or other
  modified_base (303)..(303): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccngcagaaacctggccaggcctcccgaggtcctcctctattttagngatcgactactaccgaacgacggcctacgtcggacacgtcccgagtccgtaggttcgacggtggcgtagggttcggggtcgtacgggaactacggtaccttaccgaccttcctacccaacctagtacccgacgtaccgtaccggtacccgtaaggaccgtacccgttaggtaaacgtttacgtttttacggtaaccgttttaagtttttaaactttaccgttacggttaccgtaacgtaccggtaacggtaccggttaacgtaaccgtaaccggttccggtacccctttacccgttacccggtttaccccgggttaccgggggaacccggggtaaaccgggggtaaacccgggtaaagggggttacgggtaaaacggtaaaccggttaaaaccggtaaaaaccgggttacggttaccggggtaacggtacccgttacggtaacccgttaccgttacgtttaccggttaccggtttaccg

SEQ ID NO: 415996 - DNA, 689 bp, Homo sapiens
  misc_feature: GZ8MTXP02JR2HS.3.72.G06.1.454.CMB.2.raw
  modified_base (203)..(203): a, c, t, g, unknown or other
  modified_base (296)..(296): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgctccgaggggaaangccactctctcctgcagggccagtcagagtgttagcagctacttagcctggtaccagcagaacctggccaggcctccgagctcctctatttangatgctactccaacgacgggcccacgtggcctactccccgagtccctagggttcagggtcgagtacgggttggggtacgtaggggactacggtacctttacacccgttcctacccaacccgtatccgaagtacccgacgtacccgtaaggacctcccgttaagaacgtttagttttcggacttaaagtttttacttactgttacgaacggtcgtacggtacggttacgaaccgtaccggttccggtacccttccgtaccctaccccggggttacggggaaccggggttaaccgggggaaaccggtaacgggggtaggaaacggtaaccgtaaaccgtaaaaccggtaagtggtaaccggctacgaccccgaacttcgttccgttacttacccg

SEQ ID NO: 415997 - DNA, 504 bp, Homo sapiens
  misc_feature: GZ8MTXP02FPKFF.3.72.G06.1.454.CMB.2.raw
  modified_base (200)..(200): a, c, t, g, unknown or other
  modified_base (277)..(277): a, c, t, g, unknown or other
  modified_base (282)..(283): a, c, t, g, unknown or other
  modified_base (285)..(285): a, c, t, g, unknown or other
  modified_base (289)..(289): a, c, t, g, unknown or other
  modified_base (302)..(302): a, c, t, g, unknown or other
  modified_base (304)..(304): a, c, t, g, unknown or other
  modified_base (319)..(319): a, c, t, g, unknown or other
  modified_base (334)..(334): a, c, t, g, unknown or other
  modified_base (339)..(339): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctccagatacaaccggagaaattgtgttgacacagtctccagccacctgtctttgctccaggggaaangccactctctcctgcagggccagtcagagtgtagcagctactgcctggtaccagcagaactggcagctccagctctnattanntncacncagcggcagtgcncnccagctagtcagtgngaggtggtcaggacngctcnctcacacatcagacacgactagacgtcgtagagttagtttgacttagtttacgttattgacacgcgtagtacgtacgacgtacgtcgtcctcgtacgtaccgtcggacggacggacgaggtcgagtacgtaacgaacgtacgtgcgctacgactactctcgtctc

SEQ ID NO: 415998 - DNA, 620 bp, Homo sapiens
  misc_feature: GZ8MTXP02GYTWR.3.72.G06.1.454.CMB.2.raw
  modified_base (200)..(200): a, c, t, g, unknown or other
  modified_base (262)..(262): a, c, t, g, unknown or other
  modified_base (277)..(277): a, c, t, g, unknown or other
  modified_base (284)..(285): a, c, t, g, unknown or other
  modified_base (288)..(288): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctcccagatacaaccggagaaattgtgttgacacagtctccagccacctgtctttgctcaggggaangccatctctctgcagggccagtcagagtgttagcagctacttagcctggaccagcagaaccnggcagctccagctcntatttannatnacactaccgaagcggaccagtgaccactacccagaccgtaggttcaggtcgacgtagggtcggtacgtagggactcgtaccttccacttccaccgaactgtacgaacgacgaacgtaccgtaacggacgtaccgtaagtaaacgtttactttaacgaaccttaaaccgtttacttacgttacgtaaccaacggtacgtactagacctcgtaccctcccgtctacgtacggttacgggacggtaacggtaacgaagggtaggaacgtaacgtaacgtaaaacgtacgttaggtacggtaactacgacctaactcttaccgttacgttacttac

SEQ ID NO: 415999 - DNA, 607 bp, Homo sapiens
  misc_feature: GZ8MTXP02JEWBX.3.72.G06.1.454.CMB.2.raw
  modified_base (202)..(202): a, c, t, g, unknown or other
  modified_base (230)..(230): a, c, t, g, unknown or other
  modified_base (275)..(275): a, c, t, g, unknown or other
  modified_base (283)..(283): a, c, t, g, unknown or other
  modified_base (289)..(289): a, c, t, g, unknown or other
  modified_base (308)..(308): a, c, t, g, unknown or other
  modified_base (385)..(385): a, c, t, g, unknown or other
  modified_base (464)..(464): a, c, t, g, unknown or other
  modified_base (469)..(469): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccacctgtctttgtctccaggggaaangccactctctcctgcagggccagtcagngtgttagcagctacttagcctggtaccagcagaacctggcaggcnccagctcnatttangatgacatacccgaaacgnggggcccacgtcgggacctacgtaccccgagtccgtaaggttccaagggtcgacgtaggtcggggttcaggggaacnggtaacctctacttccacaacccagtccagacagacctagacgcctagaagtattttgactagttttatacgtgttacnggtanacggtacgtaagaccgaaaccgttcggacccttcgtacccgtaccgttaccgggaccggacggggtaaacccaggggtaacgacgtaacgtacgaaaacgacgttgaaggctcggaccacgtaacttcgtacgttacc

SEQ ID NO: 416000 - DNA, 671 bp, Homo sapiens
  misc_feature: GZ8MTXP02IWYO0.3.72.G06.1.454.CMB.2.raw
  modified_base (289)..(289): a, c, t, g, unknown or other
  modified_base (297)..(297): a, c, t, g, unknown or other
tcagagacgcactccacgaccggtgctcgatttagctacgactgcaagggaaaggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctccncatttagngatgcactaccaacgacggccacgtcgcactcccgagccgtaggttcacggtcggcgtaggttcgggtcgtagggactacgtaccttcaccttcctaccaacgtacgtccaacgaccgtaacgtacccgtaaggacgtaccgtaaggtaacgtttagttttacgaacgtttaacgttttacgtttacgttacgttacgtaacgtccgtaacgggtacggtaacgtaccgtaacgtcggtcccttaccgttaccgtaccgggttcggggaacggggtaacgggaccggtaaagggtacggtaaacgtaacgtaaaccgtaaaacgtacgttaggtaaccggtacgtacggtacctacgtacgttcgttacgttac

SEQ ID NO: 416001 - DNA, 636 bp, Homo sapiens
  misc_feature: GZ8MTXP02JY9JG.3.72.G06.1.454.CMB.2.raw
  modified_base (301)..(301): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctccagatacaaccggagaaattgtgttgacacagtctccagccaccctgtctttgtctcgaggggaaagagccactctctcctgcagggccagtcagagttgttagcagctacttagcctggaccagcaagaacctggccaggcctcccaggtcctcctctatttangatgctactccaagcgggccacgtgcactcccagcctaggttcacggtggactagggttcggggctaggggaactcggtaccttcgacttccgtaccaaccctatccgagccgacgacctaagacgtccgtagtaacgttattttgacttagttttacttagttcgtactacgcgtacgtacgtagaccgtaacgttcggtcccgttacgtcccgtaaccgttcggggaccggggaacggggaacccgtaaggggtacgggtaacgaacgttaaccgaaaacgtaaccggttggtaacggtacgttacggacctaccgtacttccgttcgtttcc

SEQ ID NO: 416002 - DNA, 674 bp, Homo sapiens
  misc_feature: GZ8MTXP02JYZ4S.3.72.G06.1.454.CMB.2.raw
  modified_base (204)..(204): a, c, t, g, unknown or other
  modified_base (296)..(296): a, c, t, g, unknown or other
  modified_base (312)..(312): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgtagcagctactagcctggtaccagcagaacctggccaggcctcccgagcctcctcatttangatgctatccaaacgngggcccacgtcgggacacgtccccaagcccgtaggtttccaggtcggacgtagggttcggggtctaggggacaggtaccttccgaacctccgtaccaacccgtatccgaacgtccacgtacccgtaaggacgtcccgttaaggtaaacgttatttttcgacgttaagtttttacgttaacgttgttaccgacggtcgtaggtaccggttacgaccgtaaaccggttcggtcccttcctacccgttacccggttcgggggaccgggtaacgggtaacccgaaggggtcgggaaacgtacgttaaccgaaaacggtaacgttgggcggtcgttacggacctaccgtattccgtacgtttacccg

SEQ ID NO: 416003 - DNA, 555 bp, Homo sapiens
  misc_feature: GZ8MTXP02GZN9K.3.72.G06.1.454.CMB.2.raw
  modified_base (203)..(203): a, c, t, g, unknown or other
  modified_base (298)..(298): a, c, t, g, unknown or other
  modified_base (312)..(312): a, c, t, g, unknown or other
  modified_base (366)..(366): a, c, t, g, unknown or other
  modified_base (412)..(412): a, c, t, g, unknown or other
  modified_base (434)..(434): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaangccactctctcctgcagggccagtcagagtgttagcagctacttagcctggtaccagcagaaacctggccaggcctccaggcctcctctatttangatgcatccaacgngggccacgtggccatccccagcctaggttcaggtggcaggtgggtctggggacngtaccttcgacttctcaccatcagcagcctagacgccgtagaagtntttgcttagtttactactgtanagtcagtcgtagacgtacgtcggcctcgtccaccgttcggcgggtaacggaccgtaagggtcggaacgacgtacgaaaacggacgtaggtcggacgtcgactacgtacttccgtcgttacc

SEQ ID NO: 416004 - DNA, 570 bp, Homo sapiens
  misc_feature: GZ8MTXP02IO3L9.3.72.G06.1.454.CMB.2.raw
  modified_base (205)..(205): a, c, t, g, unknown or other
  modified_base (305)..(305): a, c, t, g, unknown or other
  modified_base (323)..(323): a, c, t, g, unknown or other
  modified_base (439)..(439): a, c, t, g, unknown or other
  modified_base (547)..(547): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaaangccactctctcctgcagggccagtcagagtgttagcagtctacttagcctggtaccagcaagaaacctggccaggcctcccgaggtcctcctctatttangatgcaactccgaaacgngggcccaacgtggactactcccgagccgtaggttcacggtggctagggtgggtcgtaggggacacggtactttcgaccttcctacactatcagcacgcctagactcgtagtaagtntttgacttagtttattactgtacagtcagtcgtagcacgtgcctctcgaccgtcggacggacggaccgagggtcgaacgactacgaaaacgtacgtaggtaacggtcncggaccactacgtcgtacgtttc

SEQ ID NO: 416005 - DNA, 730 bp, Homo sapiens
  misc_feature: GZ8MTXP02I4U8U.3.72.G06.1.454.CMB.2.raw
  modified_base (203)..(203): a, c, t, g, unknown or other
  modified_base (289)..(289): a, c, t, g, unknown or other
  modified_base (295)..(295): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaanagccactctctctgcagggccagtcagagtgttagcagctacttagcctggtaccagcagaacctggccaggcctccaggctcctnatttangatcgcatcccaacgacgggtccaacgtcgggccactccccgacgccgtaggttcgaggtcgggcctagggttcggggtactacgggggaactacgggtaccttcctacccgttcctacccgtaacctagtacccgaaacgtaccgtaaccggtacccgtaaagggtaacccgtacccgttaaaggtaaacggtttaacgtttttacgggtaccttaaagtttttaacgtttacgttacggtttacgaacggtacgtaacggtaccggttaacgtacccgtaacggttcggtacccttaccgtccgttaacccggttcgggggaccgggaaacgggtacccggtaaaggggttcgggaaacgtacgtaaccgaaaacggtacgtacgggtaaggtaccgttacggaccaccggttaacttcggttactttacccg

SEQ ID NO: 416006 - DNA, 712 bp, Homo sapiens
  misc_feature: GZ8MTXP02FZ2UE.3.72.G06.1.454.CMB.2.raw
  modified_base (213)..(213): a, c, t, g, unknown or other
  modified_base (288)..(288): a, c, t, g, unknown or other
  modified_base (295)..(295): a, c, t, g, unknown or other
  modified_base (426)..(426): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctccagatacaaccggagaattgtgttgacacagtctccagccacctgtctttgctccgagggaagagccactctctccngcgaggccagtcaggagttgtagcagcttactagcctaggtaccagacagaaacctggccaggctccgagctccntagttangatgactactaccgaaacgacgggccaacgtcgggacctacgtccccgtagaccgtagggtttccaggtcggtaccgtaagggttcggggtacgtaggggaacctaggggtaccccttacaccgttacccnccgtaaaaccctacgtacgacgtaccgacccgtaccgtaacggaccgttaccgtaagtaaccgtttacgttttaacgaacctttaaaccgttactttaacgttacgttaacccgaacgtacggtacttaacggaccgttacccgtcccgttacccgttacgtttaccgtaccgggttacgggaccggggtaaacggtaaccggtaaggtaacggtaaacgtaaacgtaaaccgaaacggtacggtacggacgtaacgactaccgaacttcgtcgtacgttactccg

SEQ ID NO: 416007 - DNA, 681 bp, Homo sapiens
  misc_feature: GZ8MTXP02IHWUW.3.72.G06.1.454.CMB.2.raw
  modified_base (201)..(201): a, c, t, g, unknown or other
  modified_base (217)..(217): a, c, t, g, unknown or other
  modified_base (242)..(242): a, c, t, g, unknown or other
  modified_base (324)..(324): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctcgagggaanagccactctctcctcncgacggccagtcagtagttgttagnagctacttagcctaggtaaccaaacgaagaaacctggccacggctcccagcctcctcatctatgatgccacttacccgaaanacggggtccaacgtcggaccactccccgagtaccctaagggtttccaacggttgggacgacgggtttcggggtacgtcgggggaacctacggttaacctttccgaaccctttcccgtaacccaccaaactcgacgacgacgtaccgtaacgacgtaacccgtagtaaacgttatttagtacttagtttaacttacgttactgagtacgtagtacgttacgacgtaactacggtccgttcgttaacttccgttacggggtacgggacgggtaaccggtaaagggtacggtaaaggaacgttaacgaaaacggttagtacggggaactacgacgtacgaaccttctacgttcgtttacc

SEQ ID NO: 416008 - DNA, 665 bp, Homo sapiens
  misc_feature: GZ8MTXP02G3D9X.3.72.G06.1.454.CMB.2.raw
  modified_base (283)..(283): a, c, t, g, unknown or other
  modified_base (289)..(289): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttgcctggtaccagcagaacctgccagctccagctcntattangatgcatccaagcgggccacgtggccactccccgaagcccgaggttcacggtggctagggtggggtctaggggacaggtccttcgaccttcgaccacctatccagcacggtccttaacggacgtacccgttagtaacggttatttttacgtaacgttaagttttacgtttaacgttacggtactacgtacgaacggtccggttaacgaccgtaaaccgttcgggtaccccttccgtaccgtacccgggttacggggtaccggggaccgggtaaacccggtaaaggggtacgggaaaggaacgtaccggtaaaaccggaacgttccggtaagggttacccgtacggtaccctaccgtaacgttccgttacgttaccg

SEQ ID NO: 416009 - DNA, 711 bp, Homo sapiens
  misc_feature: GZ8MTXP02JWZGA.3.72.G06.1.454.CMB.2.raw
  modified_base (203)..(203): a, c, t, g, unknown or other
  modified_base (300)..(300): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccgaggggaangccactctctcctgcagggccagtcagagtgttagcagcttactagcctggtaccagcaagaacctggccaggcctccgaggtcctcctctatttangtatgctactaccaacggcggccaacgtcggacaccgtcccgacgtccgtaggttccgaggtggacgtagggtcggggtcgtacggggactacgggtaccttccgaccttccgtaaccaccgtaagttcccgaacgtacctacggtacccgtaaggacgtacccgttaaggtaaaccgttagttttaccgaacttaaaaccgtttacttacgttacgtaacctaaacggtacggtactacggaaccttaccgtcccgttccccgtacgttaccgttaccgggtttaccggggaccggggtaaaccggtaaccgggtaagggttacgggaacgtaaaccgtaccggtaaaaccggtacgtacgggtacgtccgtacggaccctacgtacgtttccgtacgtttacttacccg

SEQ ID NO: 416010 - DNA, 718 bp, Homo sapiens
  misc_feature: GZ8MTXP02JIE5U.3.72.G06.1.454.CMB.2.raw
  modified_base (205)..(205): a, c, t, g, unknown or other
  modified_base (260)..(260): a, c, t, g, unknown or other
  modified_base (300)..(300): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtcctccagccaccctgtctttgtctccgaggggaaangccactctctcctgcaggccagtcagagttgtagcagtctactagccgtggtacngacaagaacctgccagctcccgagcctcctctatttacgngatgactactaccgaacggcggaccaggtcggacctacgtaccccgagtccccgtaggtttaccgaggtccggacgtagggtcggggttcgtagggaactacggtacccttcaaaccgttccacctaaccgtactaccgaacgcgtaaccggtcctaaacggtccgtaaccgttaaaggtaacgtttaacgtttttcggaacgtttaacgtttttaacgttaactttcgttaacgacgtaccggtacggtacggtaaacggtaccgtaaccgtcgggtacccttaccggttacccgtacccgggttacgggggacccgggttaaacgggacccgggttaaagggggaccggtaagaaaccgttaacgaaaccgtacgttggaacgtacgtacggacctacgtactcggtactttaccg

SEQ ID NO: 416011 - DNA, 657 bp, Homo sapiens
  misc_feature: GZ8MTXP02GLAW2.3.72.G06.1.454.CMB.2.raw
tcagagacgcactccacgaccggtgctcgatttagctacgactgcaagggaaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgagaggcaggtctggtggggacagtaagtgggtactacctatgtctttgatagtcgtcgggcaaagggctaagtcggtacaccgtctactcacgtccctaccaccgaacggcccacgtccggtccctccccgtggcccctaccctccgtaccgtaagacccgacccgtaccgtcggtcgggggcaaccggtcggcccgggtcccgtacggggtcctcggtcccgtaggttaacgaacggtaccttaccgttccggacgtcgtacgttccgtacgtcggtaacgggccgggtcgtacgggaccgtaaacggggccgttacgaaacggttacgacgtcgtacgcgacgtacgacgtacgtacgacgacgtacgtacgtacgtacgtcgtacgtacgtcgtacgtaacgtacgtcgtacgacgtacgtcgtacgtacgtacgtcg

SEQ ID NO: 416012 - DNA, 699 bp, Homo sapiens
  misc_feature: GZ8MTXP02I3LEG.3.72.G06.1.454.CMB.2.raw
  modified_base (151)..(151): a, c, t, g, unknown or other
  modified_base (198)..(198): a, c, t, g, unknown or other
  modified_base (205)..(205): a, c, t, g, unknown or other
  modified_base (280)..(280): a, c, t, g, unknown or other
  modified_base (286)..(286): a, c, t, g, unknown or other
tcagagacgcactccacgaccggtgctcgatttagctacgactgcaagggaaagggggaggaactgctcagttaggacccagagggaaccatggaagccccagctcagcttctcttcctcctgctactctggctcccagatacaaccgganaaattgtgttgacacagtctcagccacctgtctttgctccagggaangccatcnctctgcaggccagtcagagtgttagcagcttatagcctggtaccagctaagaactggccaggcctcgagctcctntattangatgcactaccaacagggccacgtcggactacgtacccagtacccaggttccaggttacggcgagggtcgggtacgtacggggacaccggtacttccgtaaccgtctaccctaaccgcttaccagacccaacggtacccgtaaaggtacccgtacccgtaggtaaagttacgtttttacggaccttaaagttttacttaccgttagtaccgtacgggtacgtaaccgtcgggtaaccgttaaccgaaccgtttcggacccccgttactttacccggtaaccccgtttacgggggaacccggggtaacgggtaacccggtaaaggggttaacgggtaaacggaaccgttaaccggaaaacggtaaccgtttacgggaacggttacgacgtacccgaccagttcgtaacgtttcc

SEQ ID NO: 416013 - DNA, 616 bp, Homo sapiens
  misc_feature: GZ8MTXP02FXK47.3.72.G06.1.454.CMB.2.raw
  modified_base (201)..(201): a, c, t, g, unknown or other
  modified_base (296)..(296): a, c, t, g, unknown or other
  modified_base (299)..(299): a, c, t, g, unknown or other
  modified_base (369)..(369): a, c, t, g, unknown or other
  modified_base (391)..(391): a, c, t, g, unknown or other
  modified_base (477)..(477): a, c, t, g, unknown or other
tcagagacgcactccacgaccggtgctcgatttagctacgactgcaaggggaaagggggaggaactgctcagttaggacccagagggaaccatggaagccccagctcagcttctcttcctcctgctactctggctcccagatacaaccggagaaatttgtgttgacacagtctccagccacctgtctttgctcgagggaangccatctctcctgcagggccagtcagtagtgttagcagctactagcctggtaccagcaagaactggccaggcctacccagcctacctatatttangangacactaccgaagcggccagtcggacactcccgaagcctaggtcaggtcgctagggttggactagggacngtcctacacgttccacaaaccngtccaagcaacgtctaagacgtacccgtagaacggtttattttacggaacttaaactttacgttaagttacggtaacctaaacggnggttacttacggaactacccgttccgtcccgtacttacgtaaccggtttcggggacggtaacgggaccgtaagggtggaaacgtacgtaacgaaacgtagtcggaggaacctcgacaccgtattcgtcgtactttaccg

SEQ ID NO: 416014 - DNA, 446 bp, Homo sapiens
  misc_feature: GZ8MTXP01BP9DD.25.66.F11.1.454.CMB.2.raw
  modified_base (328)..(328): a, c, t, g, unknown or other
  modified_base (425)..(425): a, c, t, g, unknown or other
  modified_base (431)..(432): a, c, t, g, unknown or other
  modified_base (434)..(446): a, c, t, g, unknown or other
tcagactgtacagtcacgaccggtgctcgatttagtcacgcgagaagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgcaactgacgatggtggcggttatactgtcagcaaacactatcttactccgtcggacgttcggaccaagggaccaaagggtanaattcaaagcgaaactgtggcctgcacctatctgttcttcatccttcccgcctatcctgaaactgtaccagtctggagcgggctgggcaagggccanagtagnngnnnnnnnnnnnnn

SEQ ID NO: 416015 - DNA, 412 bp, Homo sapiens
  misc_feature: GZ8MTXP01BTSNP.25.66.F11.1.454.CMB.2.raw
  modified_base (365)..(365): a, c, t, g, unknown or other
  modified_base (374)..(374): a, c, t, g, unknown or other
  modified_base (378)..(378): a, c, t, g, unknown or other
  modified_base (405)..(412): a, c, t, g, unknown or other
tcagactgtacagtcacgaccggtgctcgatttagtcacgcgagaagggccaccgtcaactgcaagtccagccagagtcttttatacagtgccgacaataagaactacttagcttggtatcagcagaagccaggacagcctcctaagctgctcatttcctgggcatctacccgggatccggggtcctgaccgattcagtggcagcgggtctgggacagtatttcactctcatcatcagcgctgcaactgacgatgtggcggttatactgtcagcaacactatcttactcctcggacgttcgaccaagggaccaaggtagaattcaagcgaactgtgctgcaccatctatctcatcctccgcatcngactgtacngtcngagcgggctgggacaagggcacatagnnnnnnnn

SEQ ID NO: 416016 - DNA, 418 bp, Homo sapiens
  misc_feature: GZ8MTXP01BVX95.25.66.F11.1.454.CMB.2.raw
  modified_base (413)..(418): a, c, t, g, unknown or other
tcagactgtacagtcacgaccggtgctcgatttagtcacgcgagaagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgcaacctgacgatgtggcgttatactgtcagcaacactatcttactcctcggacgttcggccaagggaccaaggtagaattcaagcgaactgtgcctgcaccatctgtcttcatccttccgccatctgaactgtacagtctgacggcggctgggcaagggcgcatagnnnnnn

SEQ ID NO: 416017 - DNA, 422 bp, Homo sapiens
  misc_feature: GZ8MTXP01CJZ7I.25.66.F11.1.454.CMB.2.raw
  modified_base (324)..(324): a, c, t, g, unknown or other
  modified_base (419)..(422): a, c, t, g, unknown or other
tcagactgtacagtcacgaccggtgctcgatttagtcacgcgagaagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcaggcgggtctgggacagtatttcactctcatcatcagcggctgcactgacgatgtggcggttatactgtcagcaacactatcttactccgtcggacgttcggaccaagggaccaaggtanaattcaagcgaactgtaggcctgcactatctgtcttcatcctcccgcatctagaacttgtacagtctggacggtcggctaggcaaggcgcaatgnnnn

SEQ ID NO: 416018 - DNA, 429 bp, Homo sapiens
  misc_feature: GZ8MTXP02FNP0M.25.66.F11.1.454.CMB.2.raw
  modified_base (415)..(415): a, c, t, g, unknown or other
  modified_base (422)..(429): a, c, t, g, unknown or other
tcagactgtacagtcacgaccggtgctcgatttagtcacgcgagaaggaccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgcaacctgacgatgtggcggtttattactgtcagcaaacactatctttactcctcggacgtttcggccaaagggccaaaggtagaaattcaagcgaactgtggcctgcacatctgtcttcatccttccgccatctgaactgtactagtctagagcgggctggcaagggcncagtagnnnnnnnn

SEQ ID NO: 416019 - DNA, 436 bp, Homo sapiens
  misc_feature: GZ8MTXP02JUPL2.25.66.F11.1.454.CMB.2.raw
  modified_base (212)..(212): a, c, t, g, unknown or other
  modified_base (238)..(238): a, c, t, g, unknown or other
  modified_base (255)..(255): a, c, t, g, unknown or other
  modified_base (270)..(270): a, c, t, g, unknown or other
  modified_base (335)..(335): a, c, t, g, unknown or other
  modified_base (341)..(341): a, c, t, g, unknown or other
  modified_base (378)..(378): a, c, t, g, unknown or other
  modified_base (421)..(436): a, c, t, g, unknown or other
tcagactgtacagtcacgaccggtgctcgatttagtcacgcgagaagggccaccgtcaactgcaagtccagccagagtcttttatacagtgccgacaataagaactacttagcttggtatcagcagaagccaggacagcctcctaagctgctcatttcctgggcatctacccgggaatccggggtccctgaccgattcagtggcagcgggtntgggacagatttcactctcatcatcngcggctgcacctgacgntgtggcgtttatacngtcagacaacactatcttactccgtcggacgttcgacgaaacggacaaggactgtcgctgacacntccgtntcttcacttcctcccgctctcgacgtactgtaaccgngttctagggacgtcggggtcagggacaacgggtgactaagcgnnnnnnnnnnnnnnnn

SEQ ID NO: 416020 - DNA, 558 bp, Homo sapiens
  misc_feature: GZ8MTXP01D34B8.38.39.D06.1.454.CMB.2.raw
  modified_base (234)..(234): a, c, t, g, unknown or other
  modified_base (275)..(275): a, c, t, g, unknown or other
  modified_base (413)..(413): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttggtaccaanatcaccaacatcacccagcaaagtccccaaatcataattangagtcactaaacggccctcagtagttctaatcgcttctctggctccaagtctggacaaccacggctccctgacccaatctcgtgggcctccaaaccgtgacggacgaacgctacactattattgcacgcttacattanacaagcagcgtcacgttgggtgttcgggcgtagggacccgtaccgtgacccgttcgttaggcaacgcccgaagggccttccgcccccgttggttccaccgttcctccgttcccctaacccttccgtcaccggttcgaagtcccgg

SEQ ID NO: 416021 - DNA, 569 bp, Homo sapiens
  misc_feature: GZ8MTXP01EFHFR.38.39.D06.1.454.CMB.2.raw
  modified_base (217)..(217): a, c, t, g, unknown or other
  modified_base (234)..(234): a, c, t, g, unknown or other
  modified_base (276)..(276): a, c, t, g, unknown or other
  modified_base (295)..(295): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatntgtctcttggtaccaanatcaccaacatcacccaggcaaagtccccaaatcataattangagtcactaaacggccctnaggtatttctaatcgctttctctggctccaagtctggacaaccaccggcctccctgaccctatctcgtgggcctaccaacctggaacgggacgaggtctacaacttattattgacagtctacatacacaagcagcggtactacgttgggtcgttcgggcggacgggaccgtaccgtcgtaccgttcgttacggcaacggcccgaaggccttcgcccccgttggttaccttccgttccttcgttccccaacccttcctacgacgttcgaactccg

SEQ ID NO: 416022 - DNA, 525 bp, Homo sapiens
  misc_feature: GZ8MTXP01DW37J.38.39.D06.1.454.CMB.2.raw
  modified_base (219)..(219): a, c, t, g, unknown or other
  modified_base (234)..(234): a, c, t, g, unknown or other
  modified_base (294)..(294): a, c, t, g, unknown or other
  modified_base (335)..(335): a, c, t, g, unknown or other
  modified_base (407)..(407): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggaccagtcgatcaccatctcctgcactggaaccagcagtgacgttggtgttaataaatntgtctctgtaccaanatcacacatcacccaggcaaagtccccaaatcataattatgaggtcactaaacggccctnaggagtttcaatcgcttctctggctccaagtctggcaaccncggctccctgaccctaatctcgcgggcttaccaaccgtgacggacgagctcactagtattgcagctacatanacaaagcagcgtcacgttgggtgtcggcggaggaccgactgaccgtctaggtcaagcccaaggccttcgccccgtggcttacttcgtcgtcccgtcctcctcaccgtgttaactccgg

SEQ ID NO: 416023 - DNA, 559 bp, Homo sapiens
  misc_feature: GZ8MTXP01EZR9Q.38.39.D06.1.454.CMB.2.raw
  modified_base (296)..(296): a, c, t, g, unknown or other
  modified_base (430)..(430): a, c, t, g, unknown or other
  modified_base (481)..(481): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttgtaccaacatcaccaacatcacccaggcaaacgtcccaaatcataattatgagtcaactaaacggccctanaggtagtttactaatcgctttctctggctaccaagtatggacaaccgacggcctccctgaccctaatctcgtgggccctacccaaccgtgacgggacgacggtcctacacttattactgacagcctacattaanacaagcagcgtctacgttggggtgttcgggcggacggccacgtgtaccgtntacggtcaacgcccgttaaggccttccgcccctgttaccttcttcctccgtcccaaccctcctcacgtcgaacgtccg

SEQ ID NO: 416024 - DNA, 647 bp, Homo sapiens
  misc_feature: GZ8MTXP01DUIMJ.38.39.D06.1.454.CMB.2.raw
  modified_base (274)..(274): a, c, t, g, unknown or other
  modified_base (308)..(308): a, c, t, g, unknown or other
  modified_base (313)..(313): a, c, t, g, unknown or other
  modified_base (376)..(376): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataaatatgtctcttgtaccaacatcacacatcacccagacaaacgtcccaaatcaataattangagtcaactaacggcctgagtagttctaatcgtnttctntggctcatctgcaaccgcggtcctcctgacctaatctcgtggcctacccaacgtgacggacgngctactattatatgctagtctactataactaacgaacgtacgacggtaccggttacgttaacgggtttcggggtacgggtttaccgggggaaccgggtaccgggggaacccgtaacccgtcggggtaaccccgtttcgtttaacgggaccaaccgggtaccccgaaagggtcccgttacccggtccccccttcgggttacccttaccgtttcccgtaacccgggtttcccccgtccccttccgtaccgttaccggttcgaaccgttcccgg

SEQ ID NO: 416025 - DNA, 549 bp, Homo sapiens
  misc_feature: GZ8MTXP01ER9S8.38.39.D06.1.454.CMB.2.raw
  modified_base (234)..(234): a, c, t, g, unknown or other
  modified_base (275)..(275): a, c, t, g, unknown or other
  modified_base (292)..(292): a, c, t, g, unknown or other
  modified_base (333)..(333): a, c, t, g, unknown or other
  modified_base (404)..(404): a, c, t, g, unknown or other
  modified_base (408)..(408): a, c, t, g, unknown or other
  modified_base (504)..(504): a, c, t, g, unknown or other
  modified_base (531)..(531): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttgtaccaanatcacaacatcacccaggcaaagtccccaaatcataattangagtcactaacgcctanaggatttactaatcgcttctctggctcaagtctgacaaccncggcctccctgacctaatctcgtcgggcctaccaaccgtggacggacgacggctacactattatgcagctnatanacaagcagcgtctacgttggtcgttcggcggacggaccgaccgttggtaccgtacgttagggcaacgcccaagggcccttacggcccctcggttcnccgttccttcgttccccaacccttccnccacgtcgttaacgtccg

SEQ ID NO: 416026 - DNA, 508 bp, Homo sapiens
  misc_feature: GZ8MTXP01DL66V.38.39.D06.1.454.CMB.2.raw
  modified_base (330)..(330): a, c, t, g, unknown or other
  modified_base (489)..(489): a, c, t, g, unknown or other
  modified_base (495)..(508): a, c, t, g, unknown or other
tcagtcgatcacgtcacgaccggtgctcgatttagtgacatctcgcagttctttggggactttgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgagtcactaaacggccctcaggagtttctaatcgcttctctggctccaagtctggcacacggcctccctgaccatctcgtggcctccaacctgaggacgagctcactattatgcagctcatactanaagcagcgtcacgttggggtgttccgggcgggtaagggacccgtaccgtgaccccgttcttacgggtcacgcccaagcctcgcccctgtcactctcgtcccgccctccgtcacgtgacgtccgtacgtcggacgccggggctgggcgaaacgggtccgnagtagnnnnnnnnnnnnnn

SEQ ID NO: 416027 - DNA, 509 bp, Homo sapiens
  misc_feature: GZ8MTXP01EP3JX.38.39.D06.1.454.CMB.2.raw
  modified_base (216)..(216): a, c, t, g, unknown or other
  modified_base (222)..(222): a, c, t, g, unknown or other
  modified_base (228)..(228): a, c, t, g, unknown or other
  modified_base (235)..(235): a, c, t, g, unknown or other
  modified_base (247)..(247): a, c, t, g, unknown or other
  modified_base (255)..(255): a, c, t, g, unknown or other
  modified_base (262)..(262): a, c, t, g, unknown or other
  modified_base (283)..(283): a, c, t, g, unknown or other
  modified_base (286)..(286): a, c, t, g, unknown or other
  modified_base (297)..(297): a, c, t, g, unknown or other
  modified_base (316)..(316): a, c, t, g, unknown or other
  modified_base (323)..(323): a, c, t, g, unknown or other
  modified_base (376)..(376): a, c, t, g, unknown or other
  modified_base (380)..(380): a, c, t, g, unknown or other
  modified_base (382)..(382): a, c, t, g, unknown or other
  modified_base (384)..(384): a, c, t, g, unknown or other
  modified_base (386)..(387): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttgtagttataatntgtctntgacanatcacantcaccagcaaancccaaatnatattangagtcactaacgcctagagtnttntaatcgcttcnctgctcaagtctgcaaccncgctctnacatctcgtggcctacaacctggacgacgacgtctctactattatgcagctanatananananncgtcgtgtggtcggtcggcggacggacgacgtcgtcgtacgtacgcgaacgccgacgccgccgtcccgtccgttccgttccttccgtcccgtcccgtccctcctccgttacgtcgttcgtcg

SEQ ID NO: 416028 - DNA, 628 bp, Homo sapiens
  misc_feature: GZ8MTXP01CR2L4.38.39.D06.1.454.CMB.2.raw
  modified_base (463)..(463): a, c, t, g, unknown or other
  modified_base (590)..(590): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgtttggtggttataatttgtctcctgtaccaacagccaccggacaactacgaccccaaaatcatagtattatgacgtcactcactccggccctgtagggtttctaatcgtctttctctcgctactaccaagtctcggacaaccgaccggtcccccttcctacgaccctatcctcgtcgggcctccgagggtcgtaggaacgggacgtagggtaccttaatttacgttcgtagtctaagtttacaattaactaacaaaccganaccaactactctcggtcttaacggtcggaacggacggtaccaagtctaccgacgtacctaagtccaacgcccaacggttcctcccgttcccgtccggttccttaccgttccgttcccgtttcccccncccgtttccgccgtacgttacgtaacgttccggtaacg

SEQ ID NO: 416029 - DNA, 542 bp, Homo sapiens
  misc_feature: GZ8MTXP01AMIXA.38.39.D06.1.454.CMB.2.raw
  modified_base (230)..(230): a, c, t, g, unknown or other
  modified_base (238)..(239): a, c, t, g, unknown or other
  modified_base (267)..(267): a, c, t, g, unknown or other
  modified_base (284)..(284): a, c, t, g, unknown or other
  modified_base (403)..(403): a, c, t, g, unknown or other
  modified_base (433)..(433): a, c, t, g, unknown or other
  modified_base (495)..(495): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataatatgtctctgtacaanatcacacnncaccagcaaatccccaaatcataattangagtcactaacgccctnaggtatttcaatcgcttctctggctccaagtctggcaaccgccggcctccctagacccaatctcgtcgggcctcccaacctgacggacgacgctacacttattatgactagctcattanacaagcagcgtcacggttgggtcttcgggnggacggccgacgtgtaccgtcttaggccaacgccgaaggtccttccggccccctcggttccncttccgtaaccgttccccaaccgttcccacgacgttcgaacgtccgg

SEQ ID NO: 416030 - DNA, 541 bp, Homo sapiens
  misc_feature: GZ8MTXP01A2RRX.38.39.D06.1.454.CMB.2.raw
  modified_base (217)..(217): a, c, t, g, unknown or other
  modified_base (265)..(265): a, c, t, g, unknown or other
  modified_base (356)..(356): a, c, t, g, unknown or other
  modified_base (493)..(493): a, c, t, g, unknown or other
  modified_base (525)..(525): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctgtaccaacaacaccaggcaaacgccccaaactcatcattangacgtcactcatccggcctgacggggtttctactcgcttctctggctcccaagtttcggactaacgacggcctcccgtcgacctatttcgngggcctacccaggctggacggacgtaggcttagtaattttatcgtctcctacatatacgaggcagcagcctacccttatcgtcgtcggtaagtcgggaccaaggtccaaccgtctacgtcacgcccagcccaacccnttcgtcactctcgttcccaccttcctcacgtnctcatcggaagccggg

SEQ ID NO: 416031 - DNA, 714 bp, Homo sapiens
  misc_feature: GZ8MTXP01BUHYS.38.39.D06.1.454.CMB.2.raw
  modified_base (218)..(218): a, c, t, g, unknown or other
  modified_base (232)..(232): a, c, t, g, unknown or other
  modified_base (241)..(241): a, c, t, g, unknown or other
  modified_base (252)..(252): a, c, t, g, unknown or other
  modified_base (259)..(259): a, c, t, g, unknown or other
  modified_base (265)..(265): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataaatntgtctctgtacaanatcacacancaccagacaancccaatnatatangagtacactaacgcctgagtattctaatcgtcttctctggactaccaagtctaggaccaaccgaccggtcctcccgtagaccctaattcccgtcgtcgggtacccttacccgaaccgtgggaacgggacgacgtctactaacttattacttcgacctaagtcctataacttaacaacaaacggcaacggtcggtacgttaacggggtttcggggtcgggtttaccggggaaccggggtaccggggaacccgttaacccggttcggtacccgggtttacgttaaaccggggtcccgtaaccggtaaccccggaacggtccccggttccccggtaccccccgggtttcgggttaacccccttcccgtttaccccggtttccccggtttacccccgttcccccgtttaacccggtcccgttaaccgggtttcgttaaccggtttccccgggg

SEQ ID NO: 416032 - DNA, 599 bp, Homo sapiens
  misc_feature: GZ8MTXP01ELB52.38.39.D06.1.454.CMB.2.raw
  modified_base (281)..(281): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgagtctgcgtctcctggacagtcgatcaccatctcctgcactggaaccagcagtgacattggtcattataactctgtctcgtgtaccaacacaccaggccaacgccccaaatcattattatgagtcgaatcggcctnagattcaatcgcttctctggtctcaagtctggctaacaccgtcccctccctgaccatcctctgctccgagctaggaggacgaggctgtaattacgatgactaagtttaacaacgttactaaacgactacctaacttaccttcctttacggtttacgtttacggttaaccgttccgggacgggtaccggacggtacggtaccgtacccgtaatacgtacgacccgtaacgagttcctccccggttaccgttcgaacttccgttcgttaaccccgttcccctcccttaacctcggtcgttactaaccgttccggtaacgg

SEQ ID NO: 416033 - DNA, 807 bp, Homo sapiens
  misc_feature: GZ8MTXP01EX3YM.38.39.D06.1.454.CMB.2.raw
  modified_base (218)..(218): a, c, t, g, unknown or other
  modified_base (277)..(277): a, c, t, g, unknown or other
  modified_base (299)..(299): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagtctgcctccgtgtctgggtctcctggacagtcgatcaccatcctcctgcactggaaccagcagtgacgttggtgttataaatntgtctcttgtaccaacatcaccaacatcacccaggcaaacgtccccaaatcataattangaggtcaactaaacggccctanaggtagtttctaatcgtactttctcgttcggtcctacctaaaggttcctaggaccaaaccccgaccggtccctccccgtagtaaccccctaaattcccgttccgtacggggccctaccccgaaacccgttgggaaccggggaacggtaacgggtcccttacgtaaacctttagtttaacgtttcggacctaaggtacctttaaccaatttaaactaaccgaaaacgccgtaaacgggccgggtttaacccgttaacgggttttcggggggttcggtttaccgggggccggggtaacgggggtaccccgtaaacccggtttcgggtaaacccgtttccggtttaaacgggggtccaaccgggttacccccgaaaagggggtcccctttacccgggaccccccccgtttacggggttcccttaaccccgggtttcccctttaacccggttacccccccctaacccccgtttcccttcccgaacccggtttcgggttaaccttccccgggg

SEQ ID NO: 416034 - DNA, 711 bp, Homo sapiens
  misc_feature: GZ8MTXP01DV4BF.38.39.D06.1.454.CMB.2.raw
  modified_base (297)..(297): a, c, t, g, unknown or other
  modified_base (462)..(462): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtcctgggtctcctggacagtcgatcaccatcctcctgcactggaaccagcaggtgacggtttggtagtttaataaattatgttactcttggtaaccaactatcaaccaacatcaacccaggaccaaaacgtccccaaatcaattaattangagtcaactaacgcctagaggtatttctaatcgctttcacgttggctacgaagttcaggccaacacgtcggccctccctacgaaccctattccgtcgtcgggaccctaccgaaaccgttgggaacgggacgagttactactaacttattagttagaccagtcctnttaaaactaacgtaacgaacgtacgtacggtacgttacgttacggttacggggttacgggttaccggggtaccgggtaccgggtaacccggtaaccgtaccggttaccggttaccggttacggtaacggtaaccggacccggtaccggttacccgttcccgtacccccggttacccggttcccgttacccgttcccgttaccccgttaaccccgtaccccgttacccgttaccgtaaccgttcgtaacg

SEQ ID NO: 416035 - DNA, 532 bp, Homo sapiens
  misc_feature: GZ8MTXP01AL7M9.38.39.D06.1.454.CMB.2.raw
  modified_base (216)..(216): a, c, t, g, unknown or other
  modified_base (230)..(230): a, c, t, g, unknown or other
  modified_base (236)..(236): a, c, t, g, unknown or other
  modified_base (266)..(266): a, c, t, g, unknown or other
  modified_base (283)..(283): a, c, t, g, unknown or other
  modified_base (396)..(396): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataatntgtctctgtacaantcacantcaccaggcaagtccccaaatcataattangagtcactaacgccctnaggtagttctaatcgcttctctggctcaagtctaggctacccgacggcctcctgacccaatctctgggcctccaactgacggacgaggctcactattatgcagctcatactanaagcagcgtcacgttgggtgttcgggcggacgggaccacgtcgtaccgtgtaacggtcaacgccaagggcttccgtccccgtcggttccgacttccgtccgttccccaacccttccgtccacgtcgaacgtcccgg

SEQ ID NO: 416036 - DNA, 560 bp, Homo sapiens
  misc_feature: GZ8MTXP01BA8CN.38.39.D06.1.454.CMB.2.raw
  modified_base (216)..(216): a, c, t, g, unknown or other
  modified_base (231)..(231): a, c, t, g, unknown or other
  modified_base (273)..(273): a, c, t, g, unknown or other
  modified_base (290)..(290): a, c, t, g, unknown or other
  modified_base (294)..(294): a, c, t, g, unknown or other
  modified_base (307)..(307): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataatntgtctctgtaccaanatcacaacatcacccaggcaaactccccaaatcattaattangagtcactaacggcctnagtnttcaatcgcttcnctggctccaagtctggcaaccaccggtcctccctgacccaatctccgtgggcctccaacctggacgacgagctcactatatgcagctacatacacaagcacgcggtacgtacgttaggggtcggttacgggcgggacggaccgaccgtcgtaccgttcgttacggcgaacgcccgaaggtccttccgcccccgtcggttaccgccttccgttccgtccccgtaaccttcccgacttaccggtcgaacgtccgg

SEQ ID NO: 416037 - DNA, 508 bp, Homo sapiens
  misc_feature: GZ8MTXP02JE920.38.39.D06.1.454.CMB.2.raw
  modified_base (466)..(466): a, c, t, g, unknown or other
  modified_base (482)..(482): a, c, t, g, unknown or other
  modified_base (495)..(495): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaactcataattatgagtcactaaacggccctcaggagtttctaatcgcttctctggctccaagtctggcaacacgcctccctgaccatctctgggctccaacctgaggacgaggctcactattattgcagctcatatacaagcagcgtcacttgggtgttcggcggagggaccgacgtgaccgtctaggtcagcccaaggcngcccctcgtccactcncgttcccgcctcncacgtcgactccg

SEQ ID NO: 416038 - DNA, 506 bp, Homo sapiens
  misc_feature: GZ8MTXP02IOIQF.38.39.D06.1.454.CMB.2.raw
  modified_base (276)..(276): a, c, t, g, unknown or other
  modified_base (341)..(341): a, c, t, g, unknown or other
  modified_base (373)..(373): a, c, t, g, unknown or other
  modified_base (387)..(387): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtcccaaatcataattangagtcactaaacggcctcaggatttctaatcgcttctctggctccaagtctggcacacgcctccngaccatctctggctccaacctgaggacagctnactatatgcagctnatatacagcagcgtcacgttgggtgttccggcggaggaccgactggaccgtcgtaggtcacgcccgaaggcctcggccccctcggtccactcgtcgtcccgcctcctcacgtcgactcg

SEQ ID NO: 416039 - DNA, 524 bp, Homo sapiens
  misc_feature: GZ8MTXP02JZWQW.38.39.D06.1.454.CMB.2.raw
  modified_base (235)..(235): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaagtccccaaatcataattatgaggtcactaaacggccctcaggagtttctaatcgcttctctggctccaaagtctggcaaccacggcctccctgaccatctctgggctccaactgaggacgagctcactattatgcagctcatatacaaagcagcgtctagttgggtgttcggcgacgggaccgacctgaccgtcgtacgtcacgacccaaggcctcgcccccgtcgtccacttctccgttccccaccctcctacacgtcgactccg

SEQ ID NO: 416040 - DNA, 525 bp, Homo sapiens
  misc_feature: GZ8MTXP02JVE69.38.39.D06.1.454.CMB.2.raw
  modified_base (297)..(297): a, c, t, g, unknown or other
  modified_base (336)..(336): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgagtcactaaacggccctnaggagttctaatcgcttctctggctcaagtctggcaacncgcctcctgacatctctgggctccaacctgaggacgagctcactattatgcagctcatatacaagcagcgtctagttgggtgttcggcggagggaccgacgtggaccgtgttacggctacgcccgaaggcctcgcccccgtcggtcctaccttcgtccgttccccacccgttcctcgacgtcgactccg

SEQ ID NO: 416041 - DNA, 542 bp, Homo sapiens
  misc_feature: GZ8MTXP02F8DUE.38.39.D06.1.454.CMB.2.raw
  modified_base (278)..(278): a, c, t, g, unknown or other
  modified_base (297)..(297): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattangagtcactaaacggccctnaggagtttctaatcgcttctctggctccaagtctggcaaccacggcctcctgaccatctctgggctccaacctgagacgagctcactatatgcagctcatatacaagcagcgtcacgtttgggtagttcggacggtacgggaccgaccgtaggaccgttcgttaggtccacggccccaaagggtcctccggccccctcggtccacgttctccgttccccgcccttccctctacgtcgacgtcccg

SEQ ID NO: 416042 - DNA, 535 bp, Homo sapiens
  misc_feature: GZ8MTXP02JDR6C.38.39.D06.1.454.CMB.2.raw
  modified_base (298)..(298): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgtccccaaactcataattatgaggtcactaaacggcctnaggagtttcaatcgcttctctgctcaagtctggcaaccacgcctccctgaccatctctgggctccaacctgaggacgagctcacttatacttgcagtctcatatacaagcagcgtcacgttgggtagttcgcgggaggacccgactcgaccgtcgttacggcacggcccaaggcctcgcccccgtcggtacctacctcgtccgttccccgcccttcctcgtaccgttcgaacttccg

SEQ ID NO: 416043 - DNA, 533 bp, Homo sapiens
  misc_feature: GZ8MTXP02I1OX5.38.39.D06.1.454.CMB.2.raw
  modified_base (244)..(244): a, c, t, g, unknown or other
  modified_base (406)..(406): a, c, t, g, unknown or other
  modified_base (489)..(489): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacntcacccaggcaaagtcccaaatcataatttatgaggtcaactaaacggccctcaggagtttcaatcgcttctctggctcaagtctggcaccacgcctcctgaccatctctgggcctccaccgtgaggtacgaggctcactattattgcagctcatatacaancagctctacgttgggtgttcgggcggagggaccgacgtcgaccgttcgtaggtcacggcccaaggctcgccccgtcggtaccnccgtcgtccgttccccgccccttcctccaccgtcgacgttaccg

SEQ ID NO: 416044 - DNA, 503 bp, Homo sapiens
  misc_feature: GZ8MTXP02ICXNU.38.39.D06.1.454.CMB.2.raw
  modified_base (277)..(277): a, c, t, g, unknown or other
  modified_base (498)..(498): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattangagtcactaaacggcctcagagtttctaatcgcttctctggctcaagtctggcaccacgcctcctgaccatctctgggctccaacctgaggacgagctcactattatgcagctacatatacaagcagtcgtctacgttgggtgttcgggcggacgggaccgactgaccgtgtacgtcacgccaaggctcgcccctgcacgtctcgtcccacctctcacgtnactcg

SEQ ID NO: 416045 - DNA, 563 bp, Homo sapiens
  misc_feature: GZ8MTXP02JONCJ.38.39.D06.1.454.CMB.2.raw
  modified_base (296)..(296): a, c, t, g, unknown or other
  modified_base (337)..(337): a, c, t, g, unknown or other
  modified_base (410)..(410): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaatcataattatgagtcactaaacggccctnaggtagtttctaatcgcttctctgctcaagtctggcaaccncgcctccctgaccattctcgtcgggcctccgaacctgacggacgaggtcctcaactattattgctagtcctanaatataccaaagcagtcgtacacgttgggtacggttccggacgggtacgggacccgcgtgacccggtagttacggacctacgcccgaaggtccgtccgccccctcggtcctaccgtcctcgttcccccacccgtccctcgaccgtcgactccg

SEQ ID NO: 416046 - DNA, 519 bp, Homo sapiens
  misc_feature: GZ8MTXP02F4QFS.38.39.D06.1.454.CMB.2.raw
  modified_base (261)..(261): a, c, t, g, unknown or other
  modified_base (507)..(519): a, c, t, g, unknown or other
tcagtcgatcacgtcacgaccggtgctcgatttagtgacatctcgcagttctttggggactcagcctgcctccgtgtctgggtctcctggacagtcgatcaccatctcctgcactggaaccagcagtgacattggtcattataactctgtctcgtggtaccaacaacacccaggccaacgccccaaactcattatttatgaggtccggaatcggccctcaggtaatttctaatcgcttctctggctccaagtctggcaacncggccctccctgaccatctctggactccaggctgaggacgaggctagattactactgacctagttacaatataacaaagcctaacctactcccttctttcttgtttaacgttcgggcgggtacgggaccgtaggggtcgacccgttactaagtcacgcccgaaaggctccgcccctcggccaccgtctccgttccccgccctcctccacgtgacgtcgactggacgcggctggcaggcgacagtgnnnnnnnnnnnnn

SEQ ID NO: 416047 - DNA, 578 bp, Homo sapiens
  misc_feature: GZ8MTXP02GZKI4.38.39.D06.1.454.CMB.2.raw
  modified_base (274)..(274): a, c, t, g, unknown or other
  modified_base (295)..(295): a, c, t, g, unknown or other
  modified_base (382)..(382): a, c, t, g, unknown or other
  modified_base (402)..(402): a, c, t, g, unknown or other
  modified_base (408)..(408): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcacaacatcacccagcaaagtcccaaatcataattangagtcaactaaacggccctanaggtagttctaatcgcttctctgctcaagtctggcaaccacggcctccctgaccatctcgtcgggctccaacctgaggacgaggctnactatattgcagctcattanacaagnagctcagttgggtgttcgggacggacgggaccgacgtcggtaacccgtcgtttacggtcgacggtaccccgaaaggcccttacggccccccgttcgggtacccaaccgttccgttccggttaccccctaacccccgttcccgtacctaaccggttcggtaactttcccgg

SEQ ID NO: 416048 - DNA, 473 bp, Homo sapiens
  misc_feature: GZ8MTXP02GODBB.38.39.D06.1.454.CMB.2.raw
  modified_base (359)..(359): a, c, t, g, unknown or other
  modified_base (460)..(473): a, c, t, g, unknown or other
tcagtcgatcacgtcacgaccggtgctcgatttagtgacatctcgcagttctttggggactttgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactatattgcagctcatatacaagcagcgtcacttgggtgttcggcggngggaccacgtgaccgtcttaggtcagcccaagctcgccccctggtcactctcgttcccaccctcctcacgtgatcgactgagcggctggcaggcgcatagnnnnnnnnnnnnnn

SEQ ID NO: 416049 - DNA, 596 bp, Homo sapiens
  misc_feature: GZ8MTXP02H26UJ.38.39.D06.1.454.CMB.2.raw
  modified_base (275)..(275): a, c, t, g, unknown or other
  modified_base (294)..(294): a, c, t, g, unknown or other
  modified_base (332)..(332): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttgtaccaacatcaccaacatcacccagcaaacgtcccaaatcataattangagtcactaaacggcctanaggtatttactaatcgtcttctctcggtctacaagtcnggaccaaccacggccctccagaccatcctcgtcgggctacccgaacctgacggacgaggctacactattatgctagctactataactacaagcagtccgtactacgtttaggggtcggttcgggacgggacggggacccgtacgtcggaacccgttcgtacggtcaacggtcccgaaacgggtcctaccgtcccccgttcggtaccctaaccgttcccgttccgttcccccgtcccttcccgtaccgtaccgtcgtaacgtccg

SEQ ID NO: 416050 - DNA, 638 bp, Homo sapiens
  misc_feature: GZ8MTXP02G23BT.38.39.D06.1.454.CMB.2.raw
  modified_base (235)..(235): a, c, t, g, unknown or other
  modified_base (244)..(244): a, c, t, g, unknown or other
  modified_base (279)..(279): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttaataaatatgtctcttggtaccaanatcaccaanatcacccaggacaaacgtccccaaatcataattangaggtcaactaaacggccctagaggtagtttactaatcgtcttctcgtggctaccaagtctggacaacccgacgcctcctagacctactctcgtgggcctaccgaacgtgacggacgacggtcctactaacttattatcgacagtcctacaataactacaaaggcaacggtcgtccgttacggttggggttcggttccgggacgggtacggacccgtacgtacggtacccggttagttagcccgaacgtaccccgaaagggtccctcccggtaccccccgttcgggtaccctaccgttccgttcccggtttcccccccgacccgttacccgtaccgtaccggttacgtaccggtacccg

SEQ ID NO: 416051 - DNA, 541 bp, Homo sapiens
  misc_feature: GZ8MTXP02JB91E.38.39.D06.1.454.CMB.2.raw
  modified_base (244)..(244): a, c, t, g, unknown or other
  modified_base (355)..(355): a, c, t, g, unknown or other
  modified_base (472)..(472): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaanatcacccaggcaaacgtccccaaaactcaataattatgaggtcaactaaacggcccctagaggtagtttctaaatcgcttctctggctcaagtctggcaaccacgcctccngaccatctcgtgggcctaccgaacctgaacggtacgaggctacaactattacttgcagctacatatacaagtcagcgtacacgtttgggtgttcggcggaggaccgacgtgaccgtnttacggcacgtcccaaggcctacgcccctcggtccactcgtcgtccccgcctccgtcacggttcactcg

SEQ ID NO: 416052 - DNA, 582 bp, Homo sapiens
  misc_feature: GZ8MTXP02HSQBZ.38.39.D06.1.454.CMB.2.raw
  modified_base (299)..(299): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataattatgaggtcactaaacggcccctnaggtagttctaatcgcttctctggctcaagtctggcacacgcctcctgaccatctctgggctccaacctgaggacaggctcactattattgcagctcataatacaagcaagcgtactacgttggggttcgttcggggacggtacggggacccgaccgtggtaacccgttcgttacgggtccacggtccccgtaaagggccttaccggcccccgttcggtcctaaccgttccttccggtttcccccggcccctttccgcccttaaccggtcgtaacgtttccgg

SEQ ID NO: 416053 - DNA, 556 bp, Homo sapiens
  misc_feature: GZ8MTXP02H5VEY.38.39.D06.1.454.CMB.2.raw
  modified_base (192)..(192): a, c, t, g, unknown or other
  modified_base (240)..(240): a, c, t, g, unknown or other
  modified_base (272)..(272): a, c, t, g, unknown or other
  modified_base (291)..(291): a, c, t, g, unknown or other
  modified_base (351)..(351): a, c, t, g, unknown or other
  modified_base (379)..(379): a, c, t, g, unknown or other
  modified_base (388)..(388): a, c, t, g, unknown or other
  modified_base (404)..(404): a, c, t, g, unknown or other
  modified_base (409)..(409): a, c, t, g, unknown or other
  modified_base (527)..(527): a, c, t, g, unknown or other
tcagtcgatcacgtcacgaccggtgctcgatttagtgacatctcgcagttctttggggactttgcctgggctctgctgctcctcaccctcctcactcagggcacaggggtcctgggcccagtctgccctgactcagcctgcctccgtgtctgggtctcctggacagtcgatcaccatctcctgcactggaancagtagtgactatttgggtgttaataactatgtctcctggtaaccaanaacacccaggacaaagccccaaatcatattangaggtccgaatcggccctnaggtaatttctaatcgcttctctggctccaagtctggcaacacggcctcctcgaccatcnctggactccgagctagaggtacgagctnattactacngactagttacagttanaacanacactacttcctcgtttctagtttacgttcggacgggtacgggacctagggtacgaccgttactaacgtcacgcccgaaaggtccacggtccccctaggtccacctccgtccgtcccnccctctcacgtcgactcggactcggacgg

SEQ ID NO: 416054 - DNA, 640 bp, Homo sapiens
  misc_feature: GZ8MTXP02JPGA1.38.39.D06.1.454.CMB.2.raw
  modified_base (244)..(244): a, c, t, g, unknown or other
  modified_base (277)..(277): a, c, t, g, unknown or other
  modified_base (422)..(422): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaanatcacccaggcaaacgtcccaaatcataattangagtcacgtaaacggcctagaggtagttctaatcgacttctctggctccgaaagtctggacaacccgacggcctccctgacccatctcgtgggtcctaccgaacctgaacggacgtacggctcaacttattagtacgcagcctanaacttagaaccaagtcaagtcgtactacgttgggtcggttcgggacgggacgggtacccgaccgttacggtacccgttacgtttacgggaccgtaaccgtacccgtaaacggggcccgttcccggaccccccgttccgggtacccttaacccgttcccgttaaccggttcccccctaacccgttccccctacgtaaccggtttcgacgtttaacccgg

SEQ ID NO: 416055 - DNA, 536 bp, Homo sapiens
  misc_feature: GZ8MTXP02HBZMG.38.39.D06.1.454.CMB.2.raw
  modified_base (235)..(235): a, c, t, g, unknown or other
  modified_base (340)..(340): a, c, t, g, unknown or other
  modified_base (354)..(354): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaanatcaccaacatcacccaggcaaacgtcccaaactcataatttatgagtcaactaaacggccctgagtagtttctaatcgcttctctggctcaagtctggcaaccnccgcctcctgaccntctcgtggctccaactgaggcgagctagacttacactgcagttcatatacagcaactctacctcttcttgttagtcggcggaggaccgaggtcgaccgtactaagtccgacgaccacggtcgtcgccccgtcggtaccaccttctccgttcccacccgttccgtactaccgtcgacttaccg

SEQ ID NO: 416056 - DNA, 570 bp, Homo sapiens
  misc_feature: GZ8MTXP02JS9AM.38.39.D06.1.454.CMB.2.raw
  modified_base (279)..(279): a, c, t, g, unknown or other
  modified_base (407)..(407): a, c, t, g, unknown or other
  modified_base (412)..(412): a, c, t, g, unknown or other
  modified_base (416)..(416): a, c, t, g, unknown or other
tcagtcgatcacgtcacgaccggtgctcgatttagtgacatctcgcagttctttgggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaacgccccaaactcataattanagagtcaactaaacggccctacgagtatttctaatcgcttactcgtggctcaagtctcggacaaccgaccggcctaccctgaccatctcgtcgggctaccactgaggacgaggctcaactatatgcancctanatanacagacagcgtctaacgtggtcggtacgggcgggacggaccgaccgtcggaccgttacgttacggaccacggcccgaaaggtccgtccgtccccgtcggtacctccgttcgtccgttcccccgcccttacgtacccgacgtacggtactcccgg

SEQ ID NO: 416057 - DNA, 511 bp, Homo sapiens
  misc_feature: GZ8MTXP02FF35Q.38.39.D06.1.454.CMB.2.raw
  modified_base (209)..(209): a, c, t, g, unknown or other
  modified_base (228)..(228): a, c, t, g, unknown or other
  modified_base (247)..(247): a, c, t, g, unknown or other
  modified_base (263)..(263): a, c, t, g, unknown or other
  modified_base (271)..(271): a, c, t, g, unknown or other
  modified_base (328)..(328): a, c, t, g, unknown or other
  modified_base (334)..(334): a, c, t, g, unknown or other
  modified_base (356)..(356): a, c, t, g, unknown or other
  modified_base (486)..(486): a, c, t, g, unknown or other
  modified_base (501)..(511): a, c, t, g, unknown or other
tcagtcgatcacgtcacgaccggtgctcgatttagtgacatctcgcagttctttggggactcagcctgcctccgtgtctgggtctcctggacagtcgatcaccatctcctgcactggaaccagcagtgacgttggtgttataaatatgtctcttggtaccaacatcaccaacatccacccaggcaaacgtccccaaactcattaattangagtcaactaaccggcctnaggtattctaatcgcttcnctgctcagtctgcacncgcctccngaccatctcgtcggctccaaccgtgacggtacgaggctacacttattactgcagctnagttanaccagcagctcgagttggggtntccgggcgggaggccctaactggacccgttgttacgtcacgacccgaaggccctccgtcccccctcggtcctaccttccgtaccgttacccacccctcctccacgtcgactcgacgtcgacggcggtcgnggaccgagcgtacannnnnnnnnnn

SEQ ID NO: 416058 - DNA, 649 bp, Homo sapiens
  misc_feature: GZ8MTXP02JKSAS.38.39.D06.1.454.CMB.2.raw
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatacaccaacactcacccaggacaaacgtccccaaactcactaattatagaggtacaactaaacggccctacaggtagttactaatcgtcttctcgtggctacaagtctggacaacccacgtccctcctacgaccacttccgtcgtcgggtcctaccctaaccgtcgggaacggaccgaacggtccctactaaacctttattaacgttcgacgacgtcctacaattaactacgaagacctaaggtccttacgtagtttcggggtcggttcggaccgggtacgggaccctcgtacgacccgttgttacggctaccggaccgtaacggtccttacccggccccgttacgggtccctaccgttcccgtcccgttacccccacccctttaccggtaccacggttccgacgttacccgg

SEQ ID NO: 416059 - DNA, 830 bp, Homo sapiens
  misc_feature: GZ8MTXP02GQDYE.38.39.D06.1.454.CMB.2.raw
  modified_base (218)..(218): a, c, t, g, unknown or other
  modified_base (282)..(282): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtagttaataaatntgtctcttggtaccaacatcaaccaacactcacccaggacaaacgtcccaaatcaattaattangtaggtacaaccgtaaaccggcctacgtaggtactttactaagttccgtctttacctctcggtacctacgtaaacgtctaggaccaacccgtaccggtacccctccgttacgaccctaacgttccttccggtacggggtaccctacccgaaacccgttacggggaaccggggtaacgggaccgggtaccttaaccgtaaaccgtttaattttaaacggttcggaaccctaacggtccctttaaacgttaacttaaacttaaaccgaaaacggttaccggaaccgttaccggttaaccgttaacgggttttcggggttaccgggggttaccgggaaaccgggggttacggggaaccccggttaaaccggttaccggtaacccccggtttacggtttaaaccgggacccgttaaaccggaccccgggttaaacggtaccccgtttaccccggtccccccggttacgggttcccctaaccgtttcccccgggttccgttaccccccggtccctttacccggtaccgtacccggtacgttaaccgtcccggg

SEQ ID NO: 416060 - DNA, 654 bp, Homo sapiens
  misc_feature: GZ8MTXP02JSYUO.38.39.D06.1.454.CMB.2.raw
  modified_base (194)..(194): a, c, t, g, unknown or other
  modified_base (219)..(219): a, c, t, g, unknown or other
  modified_base (235)..(235): a, c, t, g, unknown or other
  modified_base (244)..(244): a, c, t, g, unknown or other
  modified_base (275)..(275): a, c, t, g, unknown or other
  modified_base (295)..(295): a, c, t, g, unknown or other
  modified_base (608)..(608): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtgttaataaatntgtctcttagaccaanatcaccaanatcacccagacaacgcccaaatcaatattangagtcaacgtaacgccctanaggtactttacaatcgtccttactctcggtctaccgtaacgtctacggaccaaaccccgccggtcccctacccgtacggaaccctagtttccgccgttcggggacccttacccgaaacgtgggaacgggacgtaaccggtctactattaacttacgtagcctaagtcctaactattaacaacgagtacacgtacgttaccgtagtttcggggtacgttacgggacggtaaccgggtaccgccgtacggacccgttagttacgccgacgttaaccgcggtccctcccggtacccctcggtacccaacccgtttntaaccccgtttaccccctaccgtaccgtaccgtacgtcgtactcgg

SEQ ID NO: 416061 - DNA, 651 bp, Homo sapiens
  misc_feature: GZ8MTXP02HYQIH.38.39.D06.1.454.CMB.2.raw
  modified_base (214)..(214): a, c, t, g, unknown or other
  modified_base (219)..(219): a, c, t, g, unknown or other
  modified_base (236)..(236): a, c, t, g, unknown or other
  modified_base (278)..(278): a, c, t, g, unknown or other
  modified_base (323)..(323): a, c, t, g, unknown or other
tcagtcgatcacgtcacgaccggtgctcgatttagtgacatctcgcagttctttggggactttgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaanaaatntgtctcttggtaccaanatcacaacatcacccaggcaaacgtccccaaatcataattanagacggtacactaaacgccctacaggtagttctaatcgtcttctntaggctaccagtctggcaacctacggcctccctgaccattctcgtacgggcctacctaaccgtggaacgacgtacggtctacaacttatttaacttcggactagctactaacgtaaactacgaaagtccgaaggtcccgtacgtaccgtttggggtcggtttccggggacggggacgggaccccgtaccgtcggtaacccggttcgtttaacgggtccgacgacccgaagggtcccttccggaccccccgttcgggtaccaccgtttaccgtcccggtttccccccgtacccttcccgtaccgtaccgggtttcgtaacgttacccgg

SEQ ID NO: 416062 - DNA, 680 bp, Homo sapiens
  misc_feature: GZ8MTXP01CN6IS.22.85.H08.1.454.CMB.2.raw
  modified_base (165)..(165): a, c, t, g, unknown or other
  modified_base (209)..(209): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcggtggtttcgtgtaggctattanaaaaggtgtcagtgtgaggtgcagttggtggagatggaggaggntgatcagccggtcgggggtccgtgagactctctgtgctgtctcgtggttcgtcgtagtggcgactacagtgagcgtcggtccggccgacggcgtaccggacggggaacggggtaccggtagggtaggtaggtagttcgttacttactttaatttaagttaggttagggttaccggttaaccgtaactaactaacctaacctaaacaacgtaaccgtaccggtacgggtaacgggaccgtactactacctactactacgaagaaacgaactaacttaccgaacgaaacaactattagttactacttaactaaataagtaaataacgtagagacgacgacggacgacgactatagtagttagtgtggttgggtcgttacgttacgttacggttacccggttccggggttacccggggtaacccggtaccggtccgtcccgtcccgttacccctaaccccgaacccgtaacccg

SEQ ID NO: 416063 - DNA, 415 bp, Homo sapiens
  misc_feature: GZ8MTXP01DJQIH.22.85.H08.1.454.CMB.2.raw
  modified_base (404)..(404): a, c, t, g, unknown or other
  modified_base (410)..(415): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggaacctggtcaccgtctcccaccctcaccaaggcccatcggtcttccccctggcaccctcctccaagagcacctctgggggcacagcggcctgggctgcctggtccaaggactacttccacgcgtatgtctgagcgggctgggcaagggcncatagnnnnnn

SEQ ID NO: 416064 - DNA, 586 bp, Homo sapiens
  misc_feature: GZ8MTXP01C5KX9.22.85.H08.1.454.CMB.2.raw
  modified_base (326)..(326): a, c, t, g, unknown or other
  modified_base (338)..(338): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatcnctacttatttanagtggtcggtaccacatactacaacagctccgtgaaagggcccgattcaccatctcagaaagacaattacccaaggaacactattgtaatcttacaaataggaaataacctagaagagccgaaggacacggcctatgtattacgtgtggttggggcttagtttacgtcgttaccccgttgggggaccccggggtaacccgtcgggtccgtacccggtcccttacccccaaccccttcccgaaccccgg

SEQ ID NO: 416065 - DNA, 550 bp, Homo sapiens
  misc_feature: GZ8MTXP01EY1KW.22.85.H08.1.454.CMB.2.raw
  modified_base (347)..(347): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttctcagtggcgactacatgagctgggtccgccaggctccaggggaaggcctggagtggatctcacttattatagtggtcggtaccanatactacaacagctccgtgaagggccgattcaccatctcagaagacaattcccaaggaacacattgtatcttacaaatggaaataacctgagagccgagacacggccatgtatactgtgttggggcttagttacgtcgaccccgttggggcccggggtaaccctggtccacccggtccttccccgtaacccttcccgaacccg

SEQ ID NO: 416066 - DNA, 621 bp, Homo sapiens
  misc_feature: GZ8MTXP01DPO1U.22.85.H08.1.454.CMB.2.raw
  modified_base (253)..(253): a, c, t, g, unknown or other
  modified_base (286)..(286): a, c, t, g, unknown or other
  modified_base (430)..(430): a, c, t, g, unknown or other
  modified_base (436)..(436): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcgtggttttcgtgtaggctattacaaaaggtgtcagtgtgaggtgcagttggtggagacgtggaggaggcttgatccgagccgtggggggtccctgagactctcctggtnctcgtctcgtggttcgtcgaggtcggacactanagtggacgtcgtcgggtccgcgacggccgtacggaagggggacgggtcgtagggaggtggtacttctacttactttagttagtaggtggtaccgtaccactactaacacaacacgtcgtacgaggacgggctatacactatcanaagaanaacactacaacgaacatatatatatactaatagtaactaactagagacgacgacgacgacgacgtatagtagttagtgtggttggtacgttacgttacgttccggttccgggttccggggttacccgggtaaccggtaccgtccgtacccgtcccgttacccctaaccccgttaacccgtaaccg

SEQ ID NO: 416067 - DNA, 552 bp, Homo sapiens
  misc_feature: GZ8MTXP01E0TBA.22.85.H08.1.454.CMB.2.raw
  modified_base (352)..(352): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactgggaggaggcttgatccagccgtggggggtccctgagactctcctgtgcagtctctgggttctcagtggcgactacatgagctgggtccgccaggctccgagggagggcctggagtggatctcacttatttatagtggtgtaccccanatactacacaagactccgtagaacgggccgattcacatctcagaagacaattccaaggaacactatgtatctacaaatgaataacctgagagccgagacacggaccatgtatacgtgtggtggggctatttacgtgaccccgttgggggcccgggacctgggccaaccggtccctccccgaccctccgaaccgaaccggg

SEQ ID NO: 416068 - DNA, 567 bp, Homo sapiens
  misc_feature: GZ8MTXP01EQTTR.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccgaggggaagggcctggagtggatctcacttatttatagtggtcggtaccacatactacaacagaactccgtagaaggggccgattcaccatctcagaagacaattcaaggaacacattagtatcttacaaatggaaataactagagagcgagacacggccatgtatacgtgtggttgggggtcttagtttacttcgaccccgttcggggacccgggggtaacccgtcggtccgacccggtccttcccctaaccccttccgaaccccg

SEQ ID NO: 416069 - DNA, 611 bp, Homo sapiens
  misc_feature: GZ8MTXP01CLXK6.22.85.H08.1.454.CMB.2.raw
  modified_base (444)..(444): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaacgggcctgggagtggattcgtcactttatttataggttggtacggtaccacatactacaaacagaactccgtagaaaggggccattcaccatctacagaagacaattcccaaggaacactattgtattctanaaataggaattaacctgaagacgaccgaggacacggcctagtgtaacttactgtgttggggtcttacgttttaacgtcggttaacccccggttgggggccccggggtaaccctcgggtaacccgtaccccggttccttacccccccgaacccgttccccaaccccgg

SEQ ID NO: 416070 - DNA, 562 bp, Homo sapiens
  misc_feature: GZ8MTXP01CFOA4.22.85.H08.1.454.CMB.2.raw
  modified_base (291)..(291): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccncaggctccagggaagggcctggagtggatctcacttattatagtggtcggtaccacatactacaacagctccgtgaaagggccgattcaccatctcagaagacaattcccaggaacacattgtatcttacaaatgggaaataacctgaagagccgaggacacgggccatgtattactgtgttggggcttagtttaacttggaccccgttgggggacccggggtaaccctgggtccacccggtccttcccctaaccccgttccaaaccccgg

SEQ ID NO: 416071 - DNA, 599 bp, Homo sapiens
  misc_feature: GZ8MTXP01C7IHN.22.85.H08.1.454.CMB.2.raw
  modified_base (358)..(358): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccgaggctccgaggggaagggcctggagtggatctctactttatttatagtggtcggtaccanatactacaacagctcgtagaagggccattcacatctacagaagacaattacccaagaacactattgtatcttacaaataggtaaactaaccgtagagacgaccggaggacaccggcctatacgtaattcgtggtggttaggggtcttaagttttacgtcggacccccggttgggggaccccggggtaacccgtcggtccgtacccggtcccttccccctaaccccgttcccgaaaccccgg

SEQ ID NO: 416072 - DNA, 572 bp, Homo sapiens
  misc_feature: GZ8MTXP01B4VIT.22.85.H08.1.454.CMB.2.raw
  modified_base (357)..(357): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggctccgaggggaagggcctggagtggatcgtctactttatttatagtggtcggtaccanatactacaacagctccgtgaacgggccgattcaccatctcagaagacaattccaaggaacactattgtatctacaaatgaaataactgagagccgaggacacggctatgtattacgtgtgttggggtcttagtttacgttcgaccccggttcgggggacccggggtaaccctcgggtccacccggtcttcccccgtaaccccttccgaaccccgg

SEQ ID NO: 416073 - DNA, 593 bp, Homo sapiens
  misc_feature: GZ8MTXP01DWA0V.22.85.H08.1.454.CMB.2.raw
  modified_base (340)..(340): a, c, t, g, unknown or other
  modified_base (356)..(356): a, c, t, g, unknown or other
  modified_base (400)..(400): a, c, t, g, unknown or other
  modified_base (432)..(432): a, c, t, g, unknown or other
  modified_base (438)..(438): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgtagttggtggagactggaggaggcttgatccagccgtgggggtccctgagactctcctgtgcagtctcgtgggtcgtcagtggcgactacatgagcgtgggtccgccaggctccgaggggaaggcctgggagtggatctctacttatttanagtggtagtaccccanatactacacaagactcgtgaaagggccattcacatctacagaanacaattccaaggaacactatgtaatcttaaanaaatanaaactaacgagagacgacgagacgacgactagtgttatacgtggtggtcgggttacttacgtttacgtccggtaccccgggttcgggggacccgggttacccgttcggtccctaacccgtccctacccccgaccctaacccgaacccgaaccggg

SEQ ID NO: 416074 - DNA, 546 bp, Homo sapiens
  misc_feature: GZ8MTXP01BM3HR.22.85.H08.1.454.CMB.2.raw
  modified_base (352)..(352): a, c, t, g, unknown or other
  modified_base (532)..(532): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatgtagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcacttatttatagtggtcggtaccanatactacaacagaactccgtgaaggggccattcaccatctcagaagacaattccaggaacacattgtatcttcaaatggaataacctgagagccgaggacacggccatgtatactgtgttggggcagttactgaccccgttgggggcccggggaaccctgggtccacccgtccttccccncccttccgaacccg

SEQ ID NO: 416075 - DNA, 550 bp, Homo sapiens
  misc_feature: GZ8MTXP01EMCWK.22.85.H08.1.454.CMB.2.raw
  modified_base (524)..(524): a, c, t, g, unknown or other
  modified_base (536)..(536): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccaggggaagggcctggagtggatctcactttattatagtggtcggtaccacatactacaacagaactccgtgaaagggccgattcaccatctcagaagacaattccaaggaacacattgtatcttacaaatggaataacctgagagccgaggacacggccatgtattactgtgttggggcttagtttacttgaccccgttgggggcccggggaaccctgggtcnccgtcttccccncccttcccaacccg

SEQ ID NO: 416076 - DNA, 584 bp, Homo sapiens
  misc_feature: GZ8MTXP01EXF9K.22.85.H08.1.454.CMB.2.raw
  modified_base (363)..(363): a, c, t, g, unknown or other
  modified_base (481)..(481): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgttcagtgtgaggtgcagttggtggagacgtggaggaggcttgatccagccgtgggggtcctgagactctcctgtgcagtctgtgggttcgtcaggtggcgactacatgagctcgggtccgccgaggctaccggaggggaacgggccgtagggagtggatctactactttattatagtggtacgaccanatactacaacagctcgtagacgggcctatcacatcctacaagaagacattcccaaagaaccatattgatacttaacaaatggaaataaccgtgaagacgcgaaggacaacggctaatntatacgtggtaggttgggacttagtttacgtcggaccccggttgggggaccccggtaacgtcgtcccgacccgtcccaccccctaacccgttcccgaacccgg

SEQ ID NO: 416077 - DNA, 671 bp, Homo sapiens
  misc_feature: GZ8MTXP01DBNV1.22.85.H08.1.454.CMB.2.raw
  modified_base (296)..(296): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccnccaggctccgaggggaggcctggagtggatctctactttatttatagtggtcggtaccacatactacaacagctcgtagaacgggccattcaccatcctacaagtaagactaaacttcccgaaaggtaaaccactattacgtaacttcttaactaaattaggaaaacttaacccgtagaaggaacgccccggaagggaccaaccgggcctaagttacggtaatttacgtgggttgggttacgggggtaccttaagttttacccgttcgggttaacccccccgggttggggggacccccggggtaaacccccgttggggtaaccccgtaaccccggtcccgttaccccccctaaccccgttcccgaaaaccccggg

SEQ ID NO: 416078 - DNA, 741 bp, Homo sapiens
  misc_feature: GZ8MTXP01D5K1D.22.85.H08.1.454.CMB.2.raw
  modified_base (339)..(339): a, c, t, g, unknown or other
  modified_base (355)..(355): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagctctcctgtgcagtctcgtgggttctcaggtggcgactacatgagctggggtccgccaggctccgaggggaacgggctaggagtggatctcatttattanagtggtacggtaccanatactacaacacgaactccgtagaaacggggccctattcaaccctatacctacaagaaacgaactaaacttacccgaaaggtaaaccaactaagttagttaaacttaccttaaactaaaattaggggtaaaacttaaacccgttaaggaaaggaacggacccggaaacgggaaaccgtaaaccggggacccgtaaagttacgttaaactttaaacgttgggttcggggttaggggggttactttaacgttttaaaccggttcccgggttaaaccccccgggtttcggggggaaccccgggggttaaacccccgttacgggggtcccctaacccccgggttccccgttacccccccgaacccccgttaacccctaaaacccccgggg

SEQ ID NO: 416079 - DNA, 627 bp, Homo sapiens
  misc_feature: GZ8MTXP01BJUTW.22.85.H08.1.454.CMB.2.raw
  modified_base (296)..(296): a, c, t, g, unknown or other
  modified_base (520)..(520): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagctgggtccnccgaggcctaccgaggggaacgggcctagggagtggatcgtctactttatttatagtggtcggtaccatatactacaacacgctccgtagaacgggccattcacatctacagaacgacaattaccaaggaacactattagtatacttaacaaattacggaaactaaacctagaagaacgccggaacggaccgaccggcctaagttagttaattacgtggttggnggggtacttaagttttaccgtcggttaccccggttgggggaccccggggtaaccttcgggtcccgtacccggtcccttaccccctaacccgttaaccccgaaccccg

SEQ ID NO: 416080 - DNA, 422 bp, Homo sapiens
  misc_feature: GZ8MTXP01BGRB9.22.85.H08.1.454.CMB.2.raw
  modified_base (416)..(422): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccggggaaccctggtcaccgtctccccaccctccaccagggcccatcggtcttccccctggaacccctcctccaagagcacctctgggggcacagcggccctggggctgcctggtcaacggactacttccacgcgtaatgtctgagcgggctgggcaaggcgcatagnnnnnnn

SEQ ID NO: 416081 - DNA, 594 bp, Homo sapiens
  misc_feature: GZ8MTXP01BZJZ7.22.85.H08.1.454.CMB.2.raw
  modified_base (351)..(351): a, c, t, g, unknown or other
  modified_base (392)..(392): a, c, t, g, unknown or other
  modified_base (428)..(428): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcgtggttttccgttgttaggctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgagggaggcctggagtggatctcacttattatagtggtcggtaccanatactacaacagctccgtagaacgggccattcacatcctanagaagactaactacaagaacactattagtatctaanaatacgaaatacgtagagacgaccgagacgacgctagtagtacttgtggttgggttgggtcttacgtttaccgtccggttaccccgggttcgggggaccccggggtaacccgttcgggtaacccgtaccccgtccccttacccccgtaaccccgttcccgaacccg

SEQ ID NO: 416082 - DNA, 621 bp, Homo sapiens
  misc_feature: GZ8MTXP01DEBHH.22.85.H08.1.454.CMB.2.raw
  modified_base (467)..(467): a, c, t, g, unknown or other
  modified_base (601)..(601): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgcagtggcgactacatgagcgtgggtccgccgaggcctccgaggggaacggccgtagggagtggatcgtcactttattatagtggtacgtaccatataactacaacagctcgtagaaacgggcctattcaccatctacaagaagacaacttccaaaggaacactaattgtaattacttacaaaattggaaactttaaaccgnggaacgacggaaccgacggaacaacggcctaattcgtaattacgtggtggttggggtacttagttttaacgtcggaccccggttcgggggacccggggtaaccctcgggtcccaccccggttcccttacccccnccccgttaacccgaacccgg

SEQ ID NO: 416083 - DNA, 415 bp, Homo sapiens
  misc_feature: GZ8MTXP01CRHPB.22.85.H08.1.454.CMB.2.raw
  modified_base (304)..(304): a, c, t, g, unknown or other
  modified_base (319)..(319): a, c, t, g, unknown or other
  modified_base (404)..(404): a, c, t, g, unknown or other
  modified_base (407)..(415): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggctatttactgaccccgtggggccgggaacctggtcaccgtcctccccaccctccacaacggccatcggtctccccngccacctctccagcncacctcgtggggcacagcggcctgggctgcctggtccaaggactacttccgacgcgtatgtctgagcgggctggcaagggctcanagnnnnnnnnn

SEQ ID NO: 416084 - DNA, 593 bp, Homo sapiens
  misc_feature: GZ8MTXP01A2C8V.22.85.H08.1.454.CMB.2.raw
  modified_base (263)..(263): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcgtggtttcgtgtaggctattcaaaggtgtccagtgtgaggtgcagttggtggagactggaggaggcttgatccagcctggggggtccctgagctctctgtgcagtctctgggttcggttcngtggcgactacatgagcgtcggtccgccgacggcgtccgacggggacgggcgtaggaggtggatctactacttatttagtagtggtccgtacacactactacaacacgcgtcgtacgaacgggacgtactactacactactacaagaacgaactaactaccgaacgaacaactatagttatacttactaaataagtaataacgtagagacgacgacgacgacgactagtagtattagtgtggttgggtcgttacgttacgttcgttcccggttcgggttaccgggtaaccgtcgtccgtccgtccgttcccctaacccgttcccgaaccg

SEQ ID NO: 416085 - DNA, 559 bp, Homo sapiens
  misc_feature: GZ8MTXP01DCZQY.22.85.H08.1.454.CMB.2.raw
  modified_base (293)..(293): a, c, t, g, unknown or other
  modified_base (352)..(352): a, c, t, g, unknown or other
  modified_base (416)..(416): a, c, t, g, unknown or other
  modified_base (420)..(420): a, c, t, g, unknown or other
  modified_base (479)..(479): a, c, t, g, unknown or other
  modified_base (546)..(546): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagatggaggaggcttgatccagccgtggggggtccctgagactctcctgtgcagtctcgtgggttcgtcagtggcgactacatgagctgggtccnccaggcctccgaggggaaggcctggagtggatctcatttattatagtggtcggtaccanatactacaacagctccgtaggaaagggccattcaccatctcagaagacaattaccaaggaacanattnatcttacaaattggaaataacctagagagcccgagacacggccatgtattacgtgtagngggggtcttagtttacgtcgaccccgttgggggcccggggtaaccctgggcctaccgccttaccccncccttccaacccg

SEQ ID NO: 416086 - DNA, 605 bp, Homo sapiens
  misc_feature: GZ8MTXP01A00B2.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagctgggtccgccgaggctccgaggggaggccgtggagtggatctctacttattatagtggtcgtacacatactacaacagctccgtagaacgggccgattcactatctacaagaacgacaacttccgaaggaaacacgtaatttacgtaattacttacaaatacgggtaaactaaccgtagaagacgccgaaggaccacggcctagtgtaacttacgtggtaggttggggtcttagtttacgtcgttaccccgggttgggggaccccggggtaacctcggtccctaccgtcccgttcccctaaccccgttccgaaccccg

SEQ ID NO: 416087 - DNA, 725 bp, Homo sapiens
  misc_feature: GZ8MTXP01E1KSA.22.85.H08.1.454.CMB.2.raw
  modified_base (356)..(356): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgctagtctcgtgggttcgtcagtggcgactacatgagcgtgggtccgccgaggcctccgaggggaaggcctggagtggatctctactttattatagtggtcgtaccanatactacaacagctccgtagaacgggccgattccgaactatctacaagaaacgactaaattacccgaaaggaaactaactaagtttagtaacttacttaactaaaatagggaaaacttaaacccgttagaacggaacggacccggaacggaaccgaaccgggaccctaagttacggtaacttttaacgtgggttgggttacggggggtacctttaacgtttttaaacccggttcccgggttaacccccccggggttcggggggaccccccggggggttaaaacccccgttcggggttaacccccgtaacccccggttccccttaccccccccgtaaccccccgttaaccccggtaaaacccccccgggg

SEQ ID NO: 416088 - DNA, 586 bp, Homo sapiens
  misc_feature: GZ8MTXP01AUEKN.22.85.H08.1.454.CMB.2.raw
  modified_base (367)..(367): a, c, t, g, unknown or other
  modified_base (413)..(413): a, c, t, g, unknown or other
  modified_base (442)..(442): a, c, t, g, unknown or other
  modified_base (558)..(558): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagctctcctgtgcagtctcgtgggttcgtcaggtggcgactacatgagtcgtcgggtcccgccgaggccgtccgagggggaacgggccgtgggagtggatctctactttattatagtggtacgtaccanatactacaacacgcgtccgtaggaacgggccgtattcactatctanaagaagacaattccgaaggaacactagtntactcttaacaaatggtaaactaccgtagacgagaccgagacacggctagtgtactcgtgtggttgggtcttagtttcgtcgaccccggttggggaccccgggtaactcggtcccnccgtcccacccctcccgttccgaacccg

SEQ ID NO: 416089 - DNA, 568 bp, Homo sapiens
  misc_feature: GZ8MTXP01EAKFW.22.85.H08.1.454.CMB.2.raw
  modified_base (294)..(294): a, c, t, g, unknown or other
  modified_base (392)..(392): a, c, t, g, unknown or other
  modified_base (467)..(467): a, c, t, g, unknown or other
  modified_base (546)..(546): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccncgaggctcgaggggacggcctggagtggactctcactttatttatagtggtacggtaccacatactacaacacgctcgtgaagggccattcacatctnagaagacaattccaagacacattagatcttaacaaatggaaactaaccgtgaacgacgaccgaggacacggactntagttattagtgtggttgggacttagtttacgtcgaccccggttgggggaccccgggtaacctcgggtccacccgtccnccccctaaccgttcccgaaccg

SEQ ID NO: 416090 - DNA, 573 bp, Homo sapiens
  misc_feature: GZ8MTXP01CUSDC.22.85.H08.1.454.CMB.2.raw
  modified_base (359)..(359): a, c, t, g, unknown or other
  modified_base (489)..(489): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgcaggctccgaggggaacgggcctgggagtggattctctactttatttataggtggtcggtaccanatactacaacagctccgtgaaacgggccattcaccatctacagaagacaattaccaaggaacactattagtatacttacaaatggaaataacctagagagccgaggacacggcctatgtattacgtgtgnggggtacttgtttacgtcgttaccccgttgggggacccgggtaaccgtcggtcacccgtccttcccctaacccgttccaacccg

SEQ ID NO: 416091 - DNA, 765 bp, Homo sapiens
  misc_feature: GZ8MTXP01CY0V6.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgctagtctcgtgggttcgtcagtggcgactacatgagcgtcggggtcccgccgacggccgtcccggaagggggaacggggtcctggggaggtggacttcctactacttttaatttagtaggttgggtaccggtaacccaacgtattaacctaaccaaaccgacgtaaccgtcccggtagggaaaccggggcctaacttccaacctatcctacgaaaggaaacgtaactaaacgttacccgaaaggaaacctaactaagtttacggtaacttactttaactaaaagttacgggtaaaacttaaacccgtaggaaacggacgacccgggaacggaaccgacccgggacctaaagttcgttaacgtttacggttggttaaggggttcgggggttaccttaagtttttaacccggtccgggttaccccccggggttggggggacccccgggggtaacccgttcgggtcccgtaccccggttccccgttacccccccaaccccgttccccgtaaaccccggg

SEQ ID NO: 416092 - DNA, 595 bp, Homo sapiens
  misc_feature: GZ8MTXP01DO1QO.22.85.H08.1.454.CMB.2.raw
  modified_base (495)..(495): a, c, t, g, unknown or other
  modified_base (568)..(568): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgtagttggtggagactggaggaggcttgatccagccgtgggggtccctgagactctcctgtgcagtctcgtgggttcgtcgaggtggcgactacagtgagcgtcgggtcccgccaggcctaccgagggaagggcctgggagtggatctctaactttatttataggtggtcgtaaccccacatactacacaaacgactccggtagaacgggcctattccacatctacaagaagactaattccaagaacactattgtaatcttacaaatgaaatactagagacgccgaagacacgacatgtattacgnggtggtgggcttacgtttcgtcggaccccggttcgggggcccgggaacccttcgggtcctaaccccggtcccnccccgaccctccgaaccgtaacccggg

SEQ ID NO: 416093 - DNA, 678 bp, Homo sapiens
  misc_feature: GZ8MTXP01CURMK.22.85.H08.1.454.CMB.2.raw
  modified_base (191)..(191): a, c, t, g, unknown or other
  modified_base (652)..(652): a, c, t, g, unknown or other
  modified_base (666)..(666): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgnaggttggtggagacgtggaggaggcttgatccagccgtgggggtccctgagactctctgtgcagtctcgtgggttcgtcaggtggcgactacagtgagcgtcgggtccgccgacggcctaccggaaggggaacggggccgtagggaggtggtacttctacttactttaagtttagtaggttcgggttaccggtacctaactaacttaaccgtaacaaactaacggtaaccgttaccgggtagggaaaccggggtccgtaacttaccgaacctattacctacgaaacggaaaacgaacctaaacgtttaacccgaaagggtaaacctaacgtaagtttacgtaacttacttaaacgtaaaatagggtaaactaaccgtagaagacgacgaagacgacgctagtatacttagtgtgttgggtcttgtttacgtcgacccggttcggggacccggtctcgtccnccgtccttaccccnccttcgaacccg

SEQ ID NO: 416094 - DNA, 689 bp, Homo sapiens
  misc_feature: GZ8MTXP01B5LCJ.22.85.H08.1.454.CMB.2.raw
  modified_base (366)..(366): a, c, t, g, unknown or other
  modified_base (413)..(413): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacagtgagcgtcgggtccgccgaggcgtccgaggggacggccgtggagtggatctctactttatttagtaggtggtacggtaccanatactacaacacgaacgtccgtaggaacgggccgattcactatctanaagaagactaacttcccgaaaggaacactattagtacttacgttaacaaaattcgggtaaaacttaacccgtaggaaacggaccggacccggaacggaaccgaaccggggtccctaaggtttaccgttaaatttaccggtaagggttggggttacggggtacttaaacgttttaccggtccgggttacccccgggttggggggttacccccgggtaacccgttcggtccccgtaccccggtccccttacccccctaacccgttcccgaaaccccgg

SEQ ID NO: 416095 - DNA, 566 bp, Homo sapiens
  misc_feature: GZ8MTXP01DB2CN.22.85.H08.1.454.CMB.2.raw
  modified_base (359)..(359): a, c, t, g, unknown or other
  modified_base (546)..(546): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtcccgcaggcctccgaggggaacgggcctgggagtggatctcgtactttatttatagtggtcggtacanatactacaacagctcgtagaaacgggccgatcaccatctacagaagacaattacccaaggaacactattgtatcttacaaataggaaactaacctagagacgccgaggacacggcctatagtatagtgtgttggggtcagtttacgtcgccccggttggggacccgggtaacctggtccaccgtccncccctcccgttccgaacccg

SEQ ID NO: 416096 - DNA, 593 bp, Homo sapiens
  misc_feature: GZ8MTXP01D6FM6.22.85.H08.1.454.CMB.2.raw
  modified_base (174)..(174): a, c, t, g, unknown or other
  modified_base (245)..(245): a, c, t, g, unknown or other
  modified_base (258)..(259): a, c, t, g, unknown or other
  modified_base (261)..(261): a, c, t, g, unknown or other
  modified_base (267)..(267): a, c, t, g, unknown or other
  modified_base (299)..(299): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcggtggtttcgtgtaggctattacaaaggtntcagtgtgaggtgcagttggtggagagtggaggaggcttgatccagccgtgggggtcctgagctctctgtnctgtctgtggtcnngngcacangtgcgcgtcggcgcgcgcgcgaggaggcgtgngtgtatctactattattagtagtgtcgtacactactactacaacacgtcgtacgtacgacggacgtactacactactactacaagaacaactaactacgaacgaactactattatactactaactaataacgtaactaacgtagaacgacgacgacgacgacgacgtagtacgttacgttagtaagtggttggtacgttacgttacgttaccggttacccgggttccggggttaccgggtaaccggtcggtccgtcccgtacccgttaccccgtaacccgttaacccgtaaccg

SEQ ID NO: 416097 - DNA, 629 bp, Homo sapiens
  misc_feature: GZ8MTXP01CS4CI.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttcgtcgagtggcgactacatgagctgggtccgccgaggctccgaggggacgggcctggagtggatctctactttatttatagtggtcgtaccacatactacaacagctccgtagaacgggccattcaccatctacaagaacgacaacttaccaaggaacactattgtaactcttaacaaattaggaaactaaaccgttgaacgacgaccggaacggacgaaccgggacctagttagttaacgtttaacgtggttacggttggggtacttagttttaaccgtcggacccccggttgggggaccccggggtaacccgtcgggtcccacccggtcccttacccccgtaaccccgttccccgaaccccggg

SEQ ID NO: 416098 - DNA, 557 bp, Homo sapiens
  misc_feature: GZ8MTXP01CVU4U.22.85.H08.1.454.CMB.2.raw
  modified_base (356)..(356): a, c, t, g, unknown or other
  modified_base (392)..(392): a, c, t, g, unknown or other
  modified_base (476)..(476): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactggaggaggcttgatccagccgtgggggtccctgagactctcctgtgcagtctcgtgggttcgtcagtggcgactacatgagctgggtccgccaggcctccgaggggaaggccgtggagtggatctcactttatttatagtggtgtaccccanatactacacaagactcgagaagggccatcacatctnagaagacaatccaggaacactattgtatctacaaatgaataacctgagacgccgaggaccaggccatcgtatctgtgtgggttntatttcgtcggacccgttcgggggcccgggaacctcgggcctaaccggtccctccccaccctcccgaacccgtaacccggg

SEQ ID NO: 416099 - DNA, 572 bp, Homo sapiens
  misc_feature: GZ8MTXP01C68UF.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcacttatttatagtggtcggtaccacatactacaacagctccgtagaaacgggccgattcaaccatctcaagaagacaattacccaaggaaacaactattgtaactacttacaaaatggaaataacctagagagccgagacgacggccatgtattactgtgttggggcagtttacgtcgaccccgttgggggaccgggaacccgtggtccacccggtccttacccccgtcccttccccgaacccgg

SEQ ID NO: 416100 - DNA, 719 bp, Homo sapiens
  misc_feature: GZ8MTXP01D1VBY.22.85.H08.1.454.CMB.2.raw
  modified_base (359)..(359): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcgaggctccgaggggaacgggcctggagtggatcgtctactttatttatagtggtcgtaccanatactacaacagctccgtagaacgggccgtattccacatctacaagaaacgacaaacttacccgaaaggaacaactaattataactacttaacaaaattagggaaaacttaaaccgtaggaaacgaacggaacccggaacgggaaccgaaccgggaccctaaagttacggttaatttaaccggtgggttcggggttaggggggtacccttaaacggtttttaacccggtttacccgggttaacccccccgggttcgggggggggttaccccccggggtaaaccccggttcgggttaaccccgtaccccgggttacccccttacccccccgtaacccccgttaaccccgaaaacccccggg

SEQ ID NO: 416101 - DNA, 590 bp, Homo sapiens
  misc_feature: GZ8MTXP01AYD0M.22.85.H08.1.454.CMB.2.raw
  modified_base (365)..(365): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctcgtgggttcgtcagtggcgactacatgagcgtgggtcccgccgaggctaccgaggggaacgggccgtgggagtggatctcgtactttatttagtaggtggtcggtaccanatactacaacagctccgtagaacgggccgattcacatcctcaagaacgacaaattcccaaggaacactattagtactactttacaaatggtaaataaccgtgagacgccgaagacacggcagtgtattacgtgtggttgggcttagttttacgtcgaccccggttgggggcccgggtaaccctgggtccacccggtccttacccctaacccgttccgaaccccgg

SEQ ID NO: 416102 - DNA, 747 bp, Homo sapiens
  misc_feature: GZ8MTXP01A5BVY.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggggttcgtcagtggcgactacatgagcgtcgggtccgccgaggccgtccgagggggaacgggcctagggaggtggacttctacgtactttatttagtaggtggtcggtacccagattacctaacaaacaacgtaacctccggtaggaaacgggtcccgattccacctatctacaagaaacgacaacttacccgaaggaaactactatttacgtaacttaccttaactaaaacttagggtaaaacttaaacccgttaggaaacggaacggaccccgggaaagggaacccgaaaccggggtaccctaagttacgtttaacgtttaaccggttgggttaggggttacggggggtaccttaaacggtttttaacccggttacccgggttaaccccccgggttcggggggaacccccgggggtaaccccgttcgggtaaccccgtaccccggtccccttacccccccgaaccccttccccgaaacccccggg

SEQ ID NO: 416103 - DNA, 578 bp, Homo sapiens
  misc_feature: GZ8MTXP01C1TMO.22.85.H08.1.454.CMB.2.raw
  modified_base (361)..(361): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggggaacgggcctgggagtggatctctactttatttataggtggtcggtaccanatactacaacagctcgagaacgggccatcacatctcagaagacaattcccgagaacactattgtatcttaacaaataggaaatacctagacgacgccgaggacacggcctatgtattactgtggttgggtccttagtttaccgtcgaccccgttgggggccccgggtaacctcgggtccacccggtcccttaccccgtaacccgttcccgaaccccg

SEQ ID NO: 416104 - DNA, 591 bp, Homo sapiens
  misc_feature: GZ8MTXP01C3RFS.22.85.H08.1.454.CMB.2.raw
  modified_base (343)..(343): a, c, t, g, unknown or other
  modified_base (358)..(358): a, c, t, g, unknown or other
  modified_base (484)..(484): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctccgaggggaagggcctgggagtggattcgtctactttatttanagtggtcggtaccanatactacaacagctccgtagaacgggccgattcaccatctacagaagacaattcccaaggaacactattgtatcttacaaatggaaactaactgagagccgagacacggcatgtattacgtgtggnggggtcttagtttaaccgtcggttaacccccggttgggggaccccggggtaacccgtcggtcccgtacccgtcccgttaccccctaaccccgttcccgaaaccccgg

SEQ ID NO: 416105 - DNA, 416 bp, Homo sapiens
  misc_feature: GZ8MTXP01ER29F.22.85.H08.1.454.CMB.2.raw
  modified_base (329)..(329): a, c, t, g, unknown or other
  modified_base (411)..(416): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgacccctggggccgggaacctggtcaccgtctccccacctccaccaacggcccatcgtccttcccctgcacccctcctccaagagcacctcngggggcacagccggccctgggctgcctggtccaaggactactccacgctatcgtctgagcggggctgggcaaggcgcatagnnnnnn

SEQ ID NO: 416106 - DNA, 649 bp, Homo sapiens
  misc_feature: GZ8MTXP01EV2E5.22.85.H08.1.454.CMB.2.raw
  modified_base (490)..(490): a, c, t, g, unknown or other
  modified_base (626)..(626): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagctgggttttccttgttgctatttcaaaaggtgttcagtgtgaggtgcaggttggtggagacgtggaggaggcttgatccgagccgtgggggtcctgagactctctgtgcagtctcgtgggttcgtcagtggcgactacatgagcgtcgggtccgcgaggcctaccggagggggaacggccgtagggaggtggacttctactactttatttagtaggtggtaccggtaccaactaataacctaacaaacgaacgtaaccgtccgggtaggaacggggcctaattaccacctatcctacaagaaacgactaaacttcgaaacggaactactattatactaccttaaanaaagtaggaaacttaaccgtaggaacgacggacccggaaggaccacgggactagtacgtacttagtggtggttgggtacttagttacgtccggacccggttcggggaccccgggtaacctcggtcccaccgtcccncccctaacccgttccgaacccgg

SEQ ID NO: 416107 - DNA, 618 bp, Homo sapiens
  misc_feature: GZ8MTXP01D4Y3O.22.85.H08.1.454.CMB.2.raw
  modified_base (304)..(304): a, c, t, g, unknown or other
  modified_base (536)..(536): a, c, t, g, unknown or other
  modified_base (600)..(600): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagttctcgttgggttcgtcgaggtggacgactacatgagcgtcggggtcccncgacggctccgagggggaacggccgtaggaggtggattcgtctactttatttagtaggttggtaccggtaccataactactacaacacgtctccggtaggaaacgggccgtattaccacatctacaagaacgaactaacttaccgaaaggaacactattgttaactacttaacaaacttaggaaacttaccgtagacgacgacccgaggacacggcctagtacgtattacgngtcggttgggaccttgttacgtcgacccgggttggggacccggtaacctcggctacccgtcccnccctaacccgccgaaccg

SEQ ID NO: 416108 - DNA, 712 bp, Homo sapiens
  misc_feature: GZ8MTXP01BSTL0.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcaggtggcgactacgatgagcgtcggggtcccgccgaggcctaccgagggggaacgggccgtagggagtggacttctactactttaatttagaggttggtccggtaacctacaattaacctacaaaccaacgtcggtaccgtagggaaacgggcccgtaattcccgaacactctacaagaacgaacaaacgtttaccgaaggaaacacgtattacgttaattacttaactaaagttaggaaaacttaaaccgtagaacggaacgaccccggaaggaacccgaaccgggacctaagttagttaacgtttaaccgtggttgggttcgggggtactttacgtttaaccggtttccggaccccgggttcggggggacccggggtaacccgttcgggtaaccctacccggtccccttacccccgtaaccccgttccccgaaacccggg

SEQ ID NO: 416109 - DNA, 562 bp, Homo sapiens
  misc_feature: GZ8MTXP01A4DKV.22.85.H08.1.454.CMB.2.raw
  modified_base (353)..(353): a, c, t, g, unknown or other
  modified_base (391)..(391): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaagggcctggagtggatctcacttattatagtggtcggtaccanatactacaacagctccgtgaagggccgattcacatctnagaagacaattcaaggaacacattagtatcttacaaatggaaactaactgacgagccgagacacggccatgtattactgtgttggggcttagtttactcggaccccgttggggcccggggtaaccctcgggtccgtacccggtccttacccctcccgttcccgaaccccgg

SEQ ID NO: 416110 - DNA, 779 bp, Homo sapiens
  misc_feature: GZ8MTXP01A88YU.22.85.H08.1.454.CMB.2.raw
  modified_base (285)..(285): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaggtgtccagtgtgaggtgcagttggtggagacgtggaggaggcttgatccagccgtgggggtccctgagactctctgtgcagttcgtcgttgggttcgtcaggtggcgactacntggagcgtcggggtccgccgaggcctccggaagggggaacggccgtgggagtggattcttactactttatttagtaggttcggtaccggtaacctactaacttaacctaaccgaaacacggtcccgtaccggtagggaacggggacccgtattacccaacctattccgtacgaaagtaaacgaacctaaacgtttacccgaaaagggtaacctaaactaagtttacgttaaacttacctttaactaaaaagttcggggtaaaacttaaacccgtagggaaacgaaccggaacccggaaacggaacccgaaccgggtaccctaagttagttaacgtttaacgtgggttcggggttacgggggtactttaacggttttaccggtacccgggttaacccccgggggttcgggggttacccccgggggtaacccttcggggtaaccctaccccgggtccccttaccccccgtaaccccgttaaccccgaaaccccggg

SEQ ID NO: 416111 - DNA, 576 bp, Homo sapiens
  misc_feature: GZ8MTXP01ERUV5.22.85.H08.1.454.CMB.2.raw
  modified_base (175)..(175): a, c, t, g, unknown or other
  modified_base (250)..(250): a, c, t, g, unknown or other
  modified_base (255)..(255): a, c, t, g, unknown or other
  modified_base (274)..(274): a, c, t, g, unknown or other
  modified_base (277)..(277): a, c, t, g, unknown or other
  modified_base (287)..(287): a, c, t, g, unknown or other
  modified_base (312)..(312): a, c, t, g, unknown or other
  modified_base (340)..(340): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcgtggttttcgtgtaggctattacaaaaggtntcagtgtgaggtgcagttggtggagactggaggaggcttgatccagccgtgggggtcctgagactctcctgtgcngtctntgggtctgagtggcactantgngcgtcggccncgagcacgagggacgcgaggagtgntctactatttatagtgtggtacgaccanatacacaacagctcgtagacggtcactacactatcgacaagaagaacaactacaacgaacactatatactactaactaataagtaactaacgtagagacgacgacgacgacgactatagtacgtagtggtggttgggtacgttacgttacgttacggttacccgggttccggggttaccgggtaaccggtcgtccgtacccgtacccgttacccctaacccgttaacccgtaaccg

SEQ ID NO: 416112 - DNA, 580 bp, Homo sapiens
  misc_feature: GZ8MTXP01A94QD.22.85.H08.1.454.CMB.2.raw
  modified_base (362)..(362): a, c, t, g, unknown or other
  modified_base (484)..(484): a, c, t, g, unknown or other
  modified_base (492)..(492): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctcgggtccgccgaggcctccgagggggaacgggccgtggagtggatctactactttattatagtggtacgtaccanatactacaacagctccgtagaacgggccattcacatctacaagaacgacaattccaaggaacactattagtactcttaacaaatacggaaataacctgaagagcccgagaccacggctagtntattacgngtgttgggtcttagtttacgtggaccccgttgggggacccggtaaccgtggtccacccgtcccttcccctaacccgttccgaacccgg

SEQ ID NO: 416113 - DNA, 556 bp, Homo sapiens
  misc_feature: GZ8MTXP01ECTM1.22.85.H08.1.454.CMB.2.raw
  modified_base (175)..(175): a, c, t, g, unknown or other
  modified_base (359)..(359): a, c, t, g, unknown or other
  modified_base (405)..(405): a, c, t, g, unknown or other
  modified_base (423)..(423): a, c, t, g, unknown or other
  modified_base (426)..(426): a, c, t, g, unknown or other
  modified_base (440)..(440): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtntccagtgtgaggtgcagttggtggagacgtggaggaggcttgatccagccgtgggggtccctgagactctcctgtgcagtctcgtgggttctcgagtggcgactacatgagcgtgggtccgccaggctccgaggggacggccgtggagtggactcgtctactttattagtagtggtcgtaccanatactacaacagctccgtagaacgggcctattcacatctacagaanacaatcaagacacattanatntacaatagaatacngacgagccgaggacacgcatgtatacgtgtgttgggaccttagttacgtcgccccggttggggacccggtaacctgggtccacccgtccttacccccgtaacccttccgaacccgg

SEQ ID NO: 416114 - DNA, 609 bp, Homo sapiens
  misc_feature: GZ8MTXP01AXKWO.22.85.H08.1.454.CMB.2.raw
  modified_base (248)..(248): a, c, t, g, unknown or other
  modified_base (522)..(522): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtggtttcgtgttaggctatttacaaaggtgtccagtgtgaggtgcagttggtggagactggaggaggcttgatccagccgtgggggtcctgagactctcctgtncagtctgtgggttctcaggtggcactacagtgagcgtcgggtcccgcgaggcctaccgagggggaacggcccgtagggagtggacttcctactactttagtttataggttggtaccggttaaccacataacctacaaacagaactccggtaggaaacgggcctaattccaaacctatactacgaagaacgaactaactaccgaacgaacactattagtactactaactaaatacggtaactaacgtagacgacgacgagacgacgctatgtatntgtgttggtcttagttcgtcggaccggttcggggacccggtaaccgtcggtccgtcccgtcccttaccccgtcccgttccgaacccg

SEQ ID NO: 416115 - DNA, 633 bp, Homo sapiens
  misc_feature: GZ8MTXP01AEL5Y.22.85.H08.1.454.CMB.2.raw
  modified_base (364)..(364): a, c, t, g, unknown or other
  modified_base (407)..(407): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatggagcgtcgggtccgccgaggcctaccgagggggaaggccgtgggagtggatctctactttattataggtggtcgtaccanatactacaacagctcgtaggaacgggccgattcactatcctanagtaaagaactaagttcccaaaggaacctacgtatttagtacttacttataaaactggtaaataaccgtgaagacgaccgaggaccacggctagtagttaactcgttggtggttggggacttaacgttttacggtaccggcccccgggttgggggaccccggggtaacccgtcgggtcccgtacccggtccccgttacccccaacccgttaaccccgaaccccggg

SEQ ID NO: 416116 - DNA, 561 bp, Homo sapiens
  misc_feature: GZ8MTXP01ASG39.22.85.H08.1.454.CMB.2.raw
  modified_base (293)..(293): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccnccaggctccgaggggaacgggcctggagtggatctctacttatttatagtggtcggtaccacatactacaacagaactcgtgaaagggccattcacatctcagaagacaattcaaggaacacattgatctacaaatggaaataacctgagagccgagacacggcctatgtactagtgtgttggggcttagtttacgtcgaccccggttgggggcccgggtaacccgtggtcccacccggtccttccccctcccgttcccgaaccccgg

SEQ ID NO: 416117 - DNA, 602 bp, Homo sapiens
  misc_feature: GZ8MTXP01EPLRK.22.85.H08.1.454.CMB.2.raw
  modified_base (298)..(298): a, c, t, g, unknown or other
  modified_base (357)..(357): a, c, t, g, unknown or other
  modified_base (428)..(428): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttctcgagtggcgactacagtgagcgtgggtcccncgaggctccgagggggaggccgtggagtggatctctatttattatagtggtcgtaccanatactacaacagctcgtagaacgggcctattcactatctacaagaagacaagttcccaaagacactagttnaactcttaacaaattggaaaactaaccgtgacgacgcccgaaggaccacggctagtagttactacgtggttgttggggtacttagtttacgttaccggttccccgggttcggggcccggggtaacccgtcggtccgtacccgccccttacccctaaccccgttccgaaccccgg

SEQ ID NO: 416118 - DNA, 643 bp, Homo sapiens
  misc_feature: GZ8MTXP01CJWWT.22.85.H08.1.454.CMB.2.raw
  modified_base (295)..(295): a, c, t, g, unknown or other
  modified_base (362)..(362): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagctgggtccnccaggcctccgagggggaacgggcctgggagtggattctctactttattataggtggtcggtaccanatactacaacagctccgtagaacggggccattcaccatctacaagaagacaattccaaggaacactattgtatacttacaaatagggaaactaaccgtgaacgacgacccggaggaaccaccggacctaataggttaacttacgtgggttcggttgggggtccttagttttaaccgttcggttacccccggttcggggggaccccgggggtaaaccccgtcggggttaaccccaccccgggttccccttccccccgtaaccccgttccccgaaaccccggg

SEQ ID NO: 416119 - DNA, 586 bp, Homo sapiens
  misc_feature: GZ8MTXP01CL22M.22.85.H08.1.454.CMB.2.raw
  modified_base (357)..(357): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccgaggctccgaggggaagggcctggagtggatctctactttatttatagtggtcggtaccanatactacaacagctcgtagaagggccgattcacatctcaagaagacaattccaaggaacacgtattgtatctacaaataggaataacctgagagccgagacacggcctagtagtattacgtgtggttggggtacttagttttacgtcggttccccgttggggggacccggggtaaccccttgggtcccgtacccggttccttcccccctaacccgttcccgaaccccgg

SEQ ID NO: 416120 - DNA, 670 bp, Homo sapiens
  misc_feature: GZ8MTXP01COSRO.22.85.H08.1.454.CMB.2.raw
  modified_base (371)..(371): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtggggttcgtcaggtggcgaactacatggagctgggtcccgccgaggccgtccgaggggaacgggcctgggagtggacttctcgtactttatttagtagtggtacgtaccanatacctacaacacgaacgtccgtaggaaacggggccctaattccaccgtatctacgaagaaagactaaacttacccgaaggaaacactattgtactacttaacaaataggaaacttaaccgtagagaacggcccgaaggacgaccggacctagtagttaacgttagtggttggttcgggggtacttacgttttaaccgtcggttacccccgggttcgggggttaccccggggtaaacccgtccgggttaacccaccccggttcccgttaccccctaacccgttaaccccgtaaccccgg

SEQ ID NO: 416121 - DNA, 576 bp, Homo sapiens
  misc_feature: GZ8MTXP01BE6DD.22.85.H08.1.454.CMB.2.raw
  modified_base (367)..(367): a, c, t, g, unknown or other
  modified_base (411)..(411): a, c, t, g, unknown or other
  modified_base (444)..(444): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccgagccgtgggggtccctgagctctcctgtgcagtctctgggttcgtcaggtggcgactacatgagcgtggggtcccgccgaggcctcccgagggggaacgggccctgggagtggatctctactttatttatagtggttcggtaccanatactacaacagctccgtgaacgggccattcacatctacagaanacaacttcaaggaaccatattgtattccttaanaaagtagaaactacgagaacgacgccgagacacgctatgtatgtgtggttggtcttagttcgtccggcccggttcggggacccggtaaccgtcggtcccgtacccgtcccaccccctaacccgccgaacccg

SEQ ID NO: 416122 - DNA, 615 bp, Homo sapiens
  misc_feature: GZ8MTXP01AOSQL.22.85.H08.1.454.CMB.2.raw
  modified_base (295)..(295): a, c, t, g, unknown or other
  modified_base (323)..(323): a, c, t, g, unknown or other
  modified_base (349)..(349): a, c, t, g, unknown or other
  modified_base (469)..(469): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggttgagctgggttttccttgttgctattcaaaggtgtccagtgtgaggtgcagttggtggagactggaggaggcttgatccaggccgtgggggtcctgagactctctgtgcagtctcgtgggttctcgagtggcgactacatgagcgtcgggtccgcnggctccgagggacggctggagtgatctntacttattatagtggtcgtaccccanatactacacaagaccgtccgtagaacgggtccattccaccattccacaagtaaacgactaaacttcccgaaggaaaccatatttgtaacttcttaacaaattcggaaaactttaacccgnggaacgaccgacccggaagaccgacggtaccagttacgtatacgtgtcgggtgggctattttaccgcggtaaccccggttcgggggaccggttaccctgggtcccaaccggttcccaccccgttaccctccgaaccggtaacccgg

SEQ ID NO: 416123 - DNA, 720 bp, Homo sapiens
  misc_feature: GZ8MTXP01DXMZG.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacagtgagcgtgggtccgccgaggcctccgagggggaacgggcctggagtggatctctactttatttagtagtggtcggtaccatatactacaaacagaacctccgtaggaaacgggccgtattccaacctatacctacgaaagaaacgaactaaacttacccgaaaggaaacctaacctaatttacgttaacttacctttaaaccaaaattaacggggtaaaacttaaacccgttaaggaaacggaacggaacccggaacgggaaaccgaacccgggaccctaagttagttaactttaccgtaaggttgggttcgggggtacttaacgttttaccgttccggaaccccgggttcggggggaccccggggtaaacccgtcgggtaacccgtaccccggttccccttaccccccgtaaccccgttccccgaaacccccggg

SEQ ID NO: 416124 - DNA, 577 bp, Homo sapiens
  misc_feature: GZ8MTXP01BM2IL.22.85.H08.1.454.CMB.2.raw
  modified_base (356)..(356): a, c, t, g, unknown or other
  modified_base (429)..(429): a, c, t, g, unknown or other
  modified_base (443)..(443): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggacgggcctgggagtggatctcgactttattatagtggtcgtaccanatactacaacagctcgtgagggccattcacatctacagaagacaattaccgaagaacactattgatcttaaanaatagaaactacgngagacgacgagacacgctagtagtattcgtgtgggttggtacttagtttaccgtccggttaccccgggttcgggggaccccgggtaacctcggtccctacccgtcccttccccgtaacccgttaaccgaacccg

SEQ ID NO: 416125 - DNA, 592 bp, Homo sapiens
  misc_feature: GZ8MTXP01CBJ4T.22.85.H08.1.454.CMB.2.raw
  modified_base (365)..(365): a, c, t, g, unknown or other
  modified_base (405)..(405): a, c, t, g, unknown or other
  modified_base (438)..(438): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtcgggtccgccgaggcctccgagggggaagggccgtggaggtggatctctactttattataggtggtcggtaccanatactacaacagctcgtagaacgggccgattcacatctanaagaagacaattccaagaacacattgtatctanaaatggaaataactgacgagacgagacacggccatagtattacgtggtagttggggtacttacgtttaacgtccggaccccggttcgggggaccccgggtaacccgtcggtccaccccggtcccttaccccctaaccccgttcccgaaccccgg

SEQ ID NO: 416126 - DNA, 548 bp, Homo sapiens
  misc_feature: GZ8MTXP01ENMNI.22.85.H08.1.454.CMB.2.raw
  modified_base (294)..(294): a, c, t, g, unknown or other
  modified_base (352)..(352): a, c, t, g, unknown or other
  modified_base (438)..(438): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccaggctccgaggggaaggcctggagtggatctcactttattatagtggtcgtaccanatactacaacagctcgtgaaagggccattcacatctcagaagacaattccaaggaacacattgatcttacaaagtgaaataacctnaacgagccgaggacacggccatgtattactgtgttggggcttagtttacgttcgaccccgttggggccggggaacctggtcaccggcttccccgaaccttcccgaacccg

SEQ ID NO: 416127 - DNA, 611 bp, Homo sapiens
  misc_feature: GZ8MTXP01CO8ZX.22.85.H08.1.454.CMB.2.raw
  modified_base (299)..(299): a, c, t, g, unknown or other
  modified_base (364)..(364): a, c, t, g, unknown or other
  modified_base (406)..(406): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgctagtctcgtggggttcgtcgaggtggcgactacatgagctgggtccnccaggctccgaggggaacgggccgtggagtggatcgtctactttatttatagtggtacgtaccanatactacaacagctccgtagacgggcgatcacatctcagaanactaatacgaaggaacactattagtatcttacaaatggaaactaaccgtgaagacgcccgaaggaccacgggccaattggtaacttacgtggtagggttcggggtacttagttttaccgttcggttacccccggttggggggaccccgggtaaccctcggggtccaccccgttccaccccccgtaaccccgttcccgaaccccgg

SEQ ID NO: 416128 - DNA, 702 bp, Homo sapiens
  misc_feature: GZ8MTXP01CWQTP.22.85.H08.1.454.CMB.2.raw
  modified_base (299)..(299): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagtcgtcgggtccnccgaggctccgagggggaacgggcctgggagtggattctctactttattagtgtggtacgtaccatatactacaaacagcctccgtagaacgggccgattccaccatctacgaagaaacgacaaagttcccgaaagggtaaaccactaagtttagtaattaccttaaacaaaacttaggggaaaactttaacccgtaggaaacggacgaccccgggaaggaaccgaaccgggccctaaagttcgtaaacgttttaacgtgggttggggttacgggggtaccttacgtttttaaaccgttccggggttaaccccccggttgggggggacccccggggtaaccccttggggtcccctaacccgggttccccttaccccccgtaaccccgttcccgaaaccccggg

SEQ ID NO: 416129 - DNA, 658 bp, Homo sapiens
  misc_feature: GZ8MTXP01DXXIY.22.85.H08.1.454.CMB.2.raw
  modified_base (582)..(582): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgttgggttcgtcgaggtggcgactacagtgagcgtcgggtcccgccgaggcctaccgagggggaacgggcctagggaggtggacttccgtactaactttaagtttagtaggttggttaccgtaacccaactaacgttaacctaaccgaaacaacgtaaccgtcccggtaagggaaacggggtccctaattccaacccgtatcctacgaaaggaaacgactaaacttacccgaaacggtaacaacctatttagacttacttaacaaatacgggtaaactaaccgtagacgacgaccgacgaacgacggctatagttatcgtgtggngggtcttagtttacgtcgacccggttggggacccggtaacctggtccacccgtccacccctaaccttccgaacccg

SEQ ID NO: 416130 - DNA, 633 bp, Homo sapiens
  misc_feature: GZ8MTXP01E3OXB.22.85.H08.1.454.CMB.2.raw
  modified_base (374)..(374): a, c, t, g, unknown or other
  modified_base (449)..(449): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgagggcctaccgagggggaacggggcccgtagggacggtggattcgtactactttatttatagtggtacgtaccanatactacaacagctcgtgaacgggcattcacatctcaagaagacaattccaaggaacactaattgtatacttaanaaactaggaaacttaaaccgtgaacgaacgaccggaacggaacgaccgggacctaagtagtacttaacgtggtaggttggggacttaagtttaccgttccggaccccggttcgggggacccgggtaacccgtcgggtaaccctacccggtccccttcccccaaccccgttccccgaaaccccgg

SEQ ID NO: 416131 - DNA, 704 bp, Homo sapiens
  misc_feature: GZ8MTXP01D1CKB.22.85.H08.1.454.CMB.2.raw
  modified_base (341)..(341): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagctgggtccgccaggcctccgaggggaggcctggagtggatctctactttattangtggtcgtaccatatactacaacagcgtccgtaggaacgggtccctaagttccacctactacctacgaagaaacgaacaaacgttacccgaaaggaaacctaacgtatttagttaacttacttaacaaaattacgggtaaaacttaaacccgttaggaaacgaacgggacccggaacgggaacgaaccggggtaccctaagttacggttaactttaacgtgggttagggttcgggggtacttaacgttttaaccggttcggttacccccgggttcggggggaccccgggggtaaccccgttcgggtccccgtaacccccgtcccgttacccccccgtaaccccgttccccgtaaacccccggg

SEQ ID NO: 416132 - DNA, 553 bp, Homo sapiens
  misc_feature: GZ8MTXP01EIU96.22.85.H08.1.454.CMB.2.raw
  modified_base (270)..(270): a, c, t, g, unknown or other
  modified_base (368)..(368): a, c, t, g, unknown or other
  modified_base (432)..(432): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcaggtctctggggttctcaggnggcgactacgatgagctgggtccgccacggcgtccgacgggaagggccgtgggagtggatctctacttattatagtcggtggtacacatactaacacngactaccgtgacgggccgactcaccatcacagagacaatacagacacattatatactacaatanaataactagagagacgacgacacgcatgtataactgttgtgggttcgtacgttacgttcgttcccgttcgggtccggggacccgtcggtccgtacccgttccctccccgaaccccgtcccg

SEQ ID NO: 416133 - DNA, 665 bp, Homo sapiens
  misc_feature: GZ8MTXP01CLFPM.22.85.H08.1.454.CMB.2.raw
  modified_base (175)..(175): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtntccagtgtgaggtgcagttggtggagacgtggaggaggcttgatccgagccgtgggggtccctgacgactctcctgtcgctagtctcgtgggttcgtcgaggtggcgactacagtggagtcgtcgggtccgccgaggccgtccggaaggggaacgggccgtagggagtggattactcgtactttatttaagtaggttcggtaccgtaccactataactacaaacacgaacctccggtaggaaacggggccctattaccacctatcctacaagaaacgtactaacttccgaaacggtaaacactattatactacttaacaaattagggaaacttaaaccgtagaacgacgaccggaggaccaccgggcctaagtgttaacttcgtggtcgggttgggtacttacgtttaccgtcggttaccccggttcgggggaccccgggtaaccgtcggtaaccgcccgtcccacccctaacccgttcccgtaacccgg

SEQ ID NO: 416134 - DNA, 719 bp, Homo sapiens
  misc_feature: GZ8MTXP01CTI69.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtggggttcgtcgagtggcgaactacagtgaggtcgtcgggtccgccgacggccgtaccgaagggggaacggccggtagggaggtggtattccgtactaactttaatttaagtaggttggtaccggtaaccaactactaactaacaaaccgtacgtaaccgtaccggtacgggaaacggggtcccgtaattccaacctactcctacgaaagaaacgactaaacttacccgaaaggtaaaccaattactttagtaacttcttaaactaaagttaggaaaacttaaaccggtagaacggacgacccggaaggaacgaaccggacctaagtagttacttaagtggtgggttaggggtacttacgttttaccgtccgggttaccccgggttcgggggacccgggtaaccgtaccggtcccgtacccggtccccttacccccgtaaccccgttcccgaaccccgg

SEQ ID NO: 416135 - DNA, 547 bp, Homo sapiens
  misc_feature: GZ8MTXP01E0DFN.22.85.H08.1.454.CMB.2.raw
  modified_base (352)..(352): a, c, t, g, unknown or other
  modified_base (529)..(529): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccgagggggagggcctgggagtggatctcactttattatagtggtcgtaccanatactacaacagctccgtgaacgggccgattcacatctacagaagacaattccaaggaacacattagtatcttacaaattggaaataaccgtagacgagccgagacacggcctatgtatacgtgtgttggggcttagttctcgcccgttggggaccgggaacctggtccaccgtccncccaacccgttcaacccg

SEQ ID NO: 416136 - DNA, 691 bp, Homo sapiens
  misc_feature: GZ8MTXP01ANTER.22.85.H08.1.454.CMB.2.raw
  modified_base (374)..(374): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtcctgagactctcctgtgcagttctcgtgggttcgtcgaggtggcgactacagtgagcgtcgggtccgccgaggccgtcccggagggggaacgggcgtagggaggtggatcgtctactttattataggtggtcggtaccanatactacaacagtcgtcgtaggaacgggccgtattccactactctacaagaacgaactaaacttacccgaaggaaacctaactaagtttacgtaacttaccttaactaaaagttacgggtaaaacttaacccgttaggaaacggaacggacccggaaaggaaccgaacccgggtaccttagtaggttaacttacggttggtgggttcggggtacttagtttaccggtcccggaccccgggttcgggggaccccggtaacccgtcggtaacccctacccgggtccccttaccccgtaaccccgttcccgaaccccggg

SEQ ID NO: 416137 - DNA, 599 bp, Homo sapiens
  misc_feature: GZ8MTXP01DD9HF.22.85.H08.1.454.CMB.2.raw
  modified_base (362)..(362): a, c, t, g, unknown or other
  modified_base (392)..(392): a, c, t, g, unknown or other
  modified_base (396)..(396): a, c, t, g, unknown or other
  modified_base (400)..(400): a, c, t, g, unknown or other
  modified_base (416)..(416): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaagtgtccagtgtgaggtgcagttggtggagacgtggaggaggcttgatccgagccgtgggggtccctgagactctcctgtgctagtctcgtgggttcgtcgagtcggcgactacatgagcgtcgggtccgccgaggcctccgaggggaacggggcctggagtggatctctactttattagtgtgtacgaccanatacacaacagctcgtagaacggcatcacntctnaganacaatcaagacatatnatctacaaatgaactacgtgaagagaccgagacgtacgctagtataacgttcgtgggtggttacggggtcttaacgttttaccgtccgggttaaccccgggttcgggggacccccggggtaaccgttcgggtccccgttaaccccgtccccttacccccgaaccccgttcccgaaaccccggg

SEQ ID NO: 416138 - DNA, 878 bp, Homo sapiens
  misc_feature: GZ8MTXP01CCXX6.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcgagtggcgaactacagtgagtcgtcgggtcccgccgaggcctacccggaagggggaacgggccgtagggaggtgggtacttcgtacgtaactttagtttaacgtaggtcgggttaccggtaacccactagtaacctaacaaaccgaacgtaaccgtccggtagggaaacgggtccgtaattccaaccgtatcctacgaaagaaacgactaaacgttcccgaaagggtaacctacttacgtttaggtaacttacctttaaacgtaaaagttacggggtaaaaactttaaaccccggttagggaaacggtaaccggaacccgggtaaacggggtaacccgaaacccgggggtccccttaaaaggtttacgggttaaactttttacccgggttaagggggtttacgggttacggggggttaccctttaaacgggttttttaaccccgggtttaccccgggttaaacccccccggggggtttcggggggttaacccccccggggggttaaaacccccgtttccgggggtaacccccgttacccccccggggttaccccttaccccccccccgggttaaccccccgttaaccccggttaaaaacccccccggggg

SEQ ID NO: 416139 - DNA, 562 bp, Homo sapiens
  misc_feature: GZ8MTXP01A8FMO.22.85.H08.1.454.CMB.2.raw
  modified_base (358)..(358): a, c, t, g, unknown or other
  modified_base (444)..(444): a, c, t, g, unknown or other
  modified_base (473)..(473): a, c, t, g, unknown or other
  modified_base (547)..(547): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggggaagggcctgggagtggatcgtcactttatttatagtggtcggtaccanatactacaacagaactccgtgaagggccgattcacatctcagaagacaattcaggaacacattgatcttacaaatggaaataaccngaagagccgagacacggccatgtattacngtgttggggcttagtttaactcggaccccgttgggggcccggggaaccctgggtcccacccgtccttacccccncccttccgaaccccg

SEQ ID NO: 416140 - DNA, 561 bp, Homo sapiens
  misc_feature: GZ8MTXP01CUTEY.22.85.H08.1.454.CMB.2.raw
  modified_base (342)..(342): a, c, t, g, unknown or other
  modified_base (357)..(357): a, c, t, g, unknown or other
  modified_base (392)..(392): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccaggggaagggcctggagtggatcgtcactttatttanagtggtcggtaccanatactacgaacagctccgtgaacgggccattcacntctcagaagactaattcccaaggaactactattagtacttacttacaaatgggaaactaaaccgtgagagacccgaggacacggctatgtatactgtgttggggcttattcgtcgacccgttggggcccgggtaacctggtccaccgtccttcccgcccttccaacccg

SEQ ID NO: 416141 - DNA, 593 bp, Homo sapiens
  misc_feature: GZ8MTXP01AP9IR.22.85.H08.1.454.CMB.2.raw
  modified_base (254)..(254): a, c, t, g, unknown or other
  modified_base (421)..(421): a, c, t, g, unknown or other
  modified_base (436)..(436): a, c, t, g, unknown or other
  modified_base (441)..(441): a, c, t, g, unknown or other
  modified_base (449)..(449): a, c, t, g, unknown or other
  modified_base (462)..(462): a, c, t, g, unknown or other
  modified_base (491)..(491): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctctgtacngtctcgtggttcgtcagtggcgactacatgagcgtcgggtcccgccgaggcctaccggaaggggaacgggccgtagggagtggatctactactttatttagtaggtggtaggtaccccactatacctacacaagactccggagaacgggccatccacatcacagaanacaatacaaagaacntattnatacttanaaatgaaatacgngagacgccgagacacggcagtcgtatcgnggtggtcgggcttagtttccgtccgaccccgggttgggggaccccgggttaccctgggtcccaaccgtcccctacccccgacctcccgaaccgtaacccggg

SEQ ID NO: 416142 - DNA, 732 bp, Homo sapiens
  misc_feature: GZ8MTXP01E0JEY.22.85.H08.1.454.CMB.2.raw
  modified_base (300)..(300): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctctgtgcagtctcgtgggttcgtcaggtggcgactacatgagcgtgggtcccncgaggctccgaggggacggcctggagtggatctctactttatttagtaggtggtacgtaccatatactacaacagcctccgtaggaacgggcctattccactatctacgaagaaacgactaaacttccgaaaggaaccacgtatttagtaacttacttaacaaaagttacgggtaaacttaaaccgtaggaacggaacggacccggaaaggaacccgaaccggggtaccctaagttacggttaaacgtttaccggtggggtttcggggttacgggggtacctttaaacggtttttacccggttacccggggaccccccggggttcgggggggggaccccccgggggtaaccccgttcggggttaacccccgtaacccccggttcccccgttaccccccccgtaacccccgttaacccccggaaacccccggg

SEQ ID NO: 416143 - DNA, 714 bp, Homo sapiens
  misc_feature: GZ8MTXP01CQJDZ.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtggaggaggcttgatccgagccgtgggggtccctgagactctcctgtgcagtctcgtggtttcgtcagtggcgactacatgacgcgtcgggtcccgccgaggcctaccggaagggggaacgggccgtagggaggtggattctacttactttagtttaagtaggttggtaccgttaacccatactaactaacaacgaacgaaccgtccggtaagggaaacggggcccgtaattccaacctatacctacaaaggaaacgaacaaacgttaccgaaaggaaactactaattagttaacttacttaactaaactaggtaaactaaaccgtgaacgacggaccgaacggaccgaacggaccctagttagttaacttacgttggtggttcggggtacttacgtttaccgttccgggttaccccgggttccggggggttaccccgggtaacccgtcgggttccccgacccggttccccttacccccccgtaacccgttccccgtaaaccccgg

SEQ ID NO: 416144 - DNA, 611 bp, Homo sapiens
  misc_feature: GZ8MTXP01AQ00P.22.85.H08.1.454.CMB.2.raw
  modified_base (376)..(376): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagtcgtggggtcccgccgagggccgtacccgagggggaacgggcccgtggggagtggattctcgtactttatttataggtggtcggtaccanatactacaacagaactcgtaggaaacgggccgtattcaccatctacagaacgacaacttaccgaaggaaacactattagtatctactaaataggaactaacgtgagacgccgaggacacggcctatgtactacgtgtgttggggtcttagtttacgtcggttccccggttcgggggcccggggtaacccgtcggtccacccggtcccttacccccgaaccccttcccgaacccgg

SEQ ID NO: 416145 - DNA, 556 bp, Homo sapiens
  misc_feature: GZ8MTXP01EYVON.22.85.H08.1.454.CMB.2.raw
  modified_base (293)..(293): a, c, t, g, unknown or other
  modified_base (332)..(332): a, c, t, g, unknown or other
  modified_base (424)..(424): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccnccaggctccgagggaggctggagtggatctcattattanagtggtcgtaccacatactacaacagctccgtagaacgggccgaattcacctatctacagaagacaattccaaggaacacattagtatctanaaatgaataactgagagccgagacacgcatgtatatgtgttggggcttagtttacgtcgaccccggttgggggcccggggaacccgtcgggtccacccggtcccttacccccaaccccttcccgaaccccgg

SEQ ID NO: 416146 - DNA, 694 bp, Homo sapiens
  misc_feature: GZ8MTXP01AKKYE.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgctagtctcgtgggttcgtcaggtggcgactacagtgacgcgtcgggtccgccgaggctaccgaggggaacgggcctgggagtggacttcgtctactttagtttagtaggttggtccgtaccatataacctacaaacacgtaacctccggtaggaacgggtccgtattccgacctatcctacgaagaaacgaactaacgttacccgaaggaacctaactagttagtacttacttaactaaaagtacgggtaaataacccgtaggaaacgacggacccggaacggaaccgaccgggtacctagttagttaacttacggttgtgggttcggggtacttacgttttaccgttccgggttaccccgggttcgggggaccccgggtaacccggttcggtcccgtaaccccgttccccttaccccgtaacccccgttccgaaaccccggg

SEQ ID NO: 416147 - DNA, 645 bp, Homo sapiens
  misc_feature: GZ8MTXP01BSH5K.22.85.H08.1.454.CMB.2.raw
  modified_base (362)..(362): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtcccgccaggcctccgaggggaacgggcctggagtggattctctactttatttataggtggtacggtaccanatacctacaacacgaacgtcgtagaacgggccgtattccacatctacaagaacgacaattcccgaaaggacaactattagtattacttaacaaattggaaaacttaaccgtagaacggacgcccggaaggaccacgggacctaagttacggtaacttcgtgggtagggttcgggggtacttaagtttaccgttccgggaccccggttcggggggaccccggggtaacccgtgggtaaccccacccggttcccacccccctaacccgttaaccccgaacccggg

SEQ ID NO: 416148 - DNA, 571 bp, Homo sapiens
  misc_feature: GZ8MTXP01C47RB.22.85.H08.1.454.CMB.2.raw
  modified_base (406)..(406): a, c, t, g, unknown or other
  modified_base (411)..(411): a, c, t, g, unknown or other
  modified_base (424)..(424): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctcgggtccgccgaggcctaccgaggggaacgggcctggagtggatcgtactactttatttagtaggtggtcggtaccagtatactacaacagcctccgtagaaacgggccatcacatctnaaganacaatcaagacanattgatctacaaatggaactactagagagccgagacacggctatgtattactggtgttggggtacagttttacgcggttaccccggttgggggaccccgggtaacctcggtccaccccgtccttcccccaacccgttccgaacccgg

SEQ ID NO: 416149 - DNA, 647 bp, Homo sapiens
  misc_feature: GZ8MTXP01B39FC.22.85.H08.1.454.CMB.2.raw
  modified_base (371)..(371): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcgggtccgccgaggcctccggagggggaacgggccgtgggaggtggactctctactttatttagtaggtggtacgtaccanatactacaacagctcgtagaacgggcctattcacatctacaagaagactaacttccgaaaggaaccactattagtacttacttaacaaataggtaaacttaaccgtagaacggaacggacccggaaggaaccgaaccgggtacctagttacgttaattacgtggtagggttggggtacttacgtttaccgtcggaccccggttcgggggaccccgggtaacccgtcgggtccctacccggtccccttacccccgtaaccccgttcccgaaccccgg

SEQ ID NO: 416150 - DNA, 622 bp, Homo sapiens
  misc_feature: GZ8MTXP01A4F9I.22.85.H08.1.454.CMB.2.raw
  modified_base (300)..(300): a, c, t, g, unknown or other
  modified_base (363)..(363): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacagtgagcgtgggtcccncgaggcctccgagggggacggccgtggagtggatctactactttattagtagtggtgtaccanatactacaacacgctccgtaggaacgggcctaattcaaccatctacgaagaaacgactaaacttaccgaaaggaacctactaatttagtactacttaacgaaactaggaaactaaccgtagagacgaccgagacacggcctatgtaattgtaagtggttggggtcttacgtttacgtcgaaccccggttcgggggacccgggtaaaccctcgggtaaccctacccggtcccaccccctaaccccgttccgaaaccccgg

SEQ ID NO: 416151 - DNA, 865 bp, Homo sapiens
  misc_feature: GZ8MTXP01CSAQT.22.85.H08.1.454.CMB.2.raw
  modified_base (283)..(283): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtggagacgtggaggaggcttgatccagccgtgggggtcctgagactctctgtgcagtctcgtgggttcgtcgagtggcgactacngtgacgctcgggtccgccgaggccgtaccgaagggggaacggccgtgggacggtggaattcgtctaacgtttatttagtaggttcggttcggtaacccacgtaacttaacctaaaccaaaacgtaacgtaacccgttccgggtaagggaaaccgggggtaccccgtaatttacccaaaccccgtaacttacccttaaccgaaaggtaaaacgaaacctaaaacctttaaccccggaaaacgggtaaaacctaaccttaaacggtttagtttaaacttaacctttaacctaaaaaatttaggggtaaaaacctttaaaacccggttaggaaacgggaaaccgggtaaccccgggaaacgggaaccgaaacccggggtaccctaaacggtttaacgttaagttttaaccggttaagggttggggttacggggggttaacttaacgtttttaaacccgggttccggttaaccccccggggtttcggggggaacccccgggggtaaaccccgttaccgggggttaaccctacccccgggttaccccttacccccccgtaacccccgttaaccccgaaacccccggg

SEQ ID NO: 416152 - DNA, 620 bp, Homo sapiens
  misc_feature: GZ8MTXP01C47O5.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaaggcctggagtggattctcgtactttatttagtagtggtacgtaccacatactacaaacagccgtccgtagaaacgggccattccacatctacaagaaagacaattacccaaggaaactaacattagtaatcttaacaaattaggaaactaaccgtagaacgacgacccggaggaccaacgggcctaagtagtattaacgtgtgggttggggtacttagttttaccgtcggttaaccccgttgggggaccccggggtaacctcggggtcctacccgggtcccttaccccaaccccgttcccgaaccccgg

SEQ ID NO: 416153 - DNA, 591 bp, Homo sapiens
  misc_feature: GZ8MTXP01CI1RP.22.85.H08.1.454.CMB.2.raw
  modified_base (370)..(370): a, c, t, g, unknown or other
  modified_base (417)..(417): a, c, t, g, unknown or other
  modified_base (444)..(444): a, c, t, g, unknown or other
  modified_base (497)..(497): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagctctcctgtgcagtctcgtgggttcgtcaggtggcgactacatgagcgtcgggtcccgccgacggcctccggaggggaacggggccgtgggagtggatctctactttattagttaggtggtcggtaccanatactacaacagctacgtgaacgggccgattcaccatcctacagaanacaattcgaagacatatgtatacttanaaataggaactaacgtgacgacgccgagacgacgctatgtattacgtggtggngggtcttacgtttacgtcggaccccggttgggggaccccgggtaacccgtcggtcccgcccttcccgccccctaacccgaacccgtaaccccgg

SEQ ID NO: 416154 - DNA, 728 bp, Homo sapiens
  misc_feature: GZ8MTXP01EYR5Z.22.85.H08.1.454.CMB.2.raw
  modified_base (295)..(295): a, c, t, g, unknown or other
  modified_base (358)..(358): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggtttttccttgttgctatttcaaaaggtgtccagtgtgaggtgcagttggtggagacgtggaggaggcttgatccagccgtgggggtcctgagctctctgtgcagtctcgtgggttcgtcaggtggcgactacatgagctgggtccnccgaggcctccgaggggacggccgtggagtggatctctactttattatagtggtacgtaccanatactacaacagcctccgtagaacgggccgattccacatctacgaagaacgactaaattccgaaaggaaactactaatttgtaaacttccttaaacaaaagttacgggtaaaacttaaacccgtagggaaacggaacggaccccggtaaaggaacccgaaccgggtaccctaagttacgttaaagtttaaccggtgggtttacgggttacgggggtacctttaaacggtttttaacccgtttcccggggttaacccccccgggtttggggggggaccccccggggtaaaaccccggttcgggttaaccccgaacccccgggtttcccccttacccccccgtaacccccgttcccccgaaaaaccccgggg

SEQ ID NO: 416155 - DNA, 610 bp, Homo sapiens
  misc_feature: GZ8MTXP01DJ8MY.22.85.H08.1.454.CMB.2.raw
  modified_base (301)..(301): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtggggttcgtcaggtggcgactacagtgagcgtcggggtccnccgagggctaccgagggggaacgggccgtgggagtggattctctactttatttagtagtggtcggtaccatatactacaacagctccgtagacgggcctattcacactctacaagaagacaattccgaaaggaacacgtattagtaatcgttacaaatggaaactaacctagagagacccgaggacctaacggcctatcgtattacgtgtcggttgggtcttagtttacgtcggaccccggttgggggaccccgggtaactccggtaacctacccggtcccttacccctaacccgttcccgaaccccgg

SEQ ID NO: 416156 - DNA, 732 bp, Homo sapiens
  misc_feature: GZ8MTXP01B8VY0.22.85.H08.1.454.CMB.2.raw
  modified_base (300)..(300): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttggatccagccgtgggggtccctgagactctcctgtgcagttctcgtgggttcgtcaggtggcgactacatgagcgtcggggtccncgaggcctccgaggggaacggccgtggagtggacttctctactttatttagtaggtcggtacggtacccagtacttaacctaacaacaacgtaaccgtacccggtacgggaaacgggccccgtaattccccgaacctacttaccctacgaaaggtaaacgaactaaacttacccgaaagggaaacctaactacgtttacgtaacttacctttaacaaaattacgggtaaaacttaaaccgtacgaaacggaacggacccggaaacggaaccgaaaccggggccctaagttacgtaacgttacgtaaggttgggttcgggggttacttagtttaccgttacgggttacccccggttgggggttaccccgggtaacccgttcggtcccgtaccccggtacccttccccccgtaaccccttccccgaaaccccgg

SEQ ID NO: 416157 - DNA, 632 bp, Homo sapiens
  misc_feature: GZ8MTXP01AUF82.22.85.H08.1.454.CMB.2.raw
  modified_base (367)..(367): a, c, t, g, unknown or other
  modified_base (383)..(383): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatggagcgtggggtcccgccgaggcctccgagggggaagggccgtgggagtggatcgtctactttatttatagtggtcgtaccanatacacaacagctcgngaacgggccatccacatctacaagaacgaacaacttacccgaaggaactaactaattgtaatacttacaaaattaggtaaactaaaccgtaggacggaagacccggaggacgaccggactagttagttacttacgtgtaggttggggtacttagtttaccgttcggaccccggttcgggggaccccggggtaacccgtcgggtaaccctacccggtccccaccccctaaccccgttcccgaaaccccgg

SEQ ID NO: 416158 - DNA, 682 bp, Homo sapiens
  misc_feature: GZ8MTXP01C9J3S.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggtcttgatccaggccgtggggggtccctggagctctcctgtgcagttctcgtgggttcgtcaggtggcgactacagtgagcgtcgggtccgccgaggcctaccgagggggaacgggccgtggagtggattctactactttatttagtagtggtaccgtaccactataactacaacagtcctcgtagaacggccattcacatctagaagaacgaactaacgttacccgaaaggtaaacctatatttacgtaacttcttaaacaaattaggggaaaacttaacccgtaggaacgacgacccggaaggaaccgaaccggctaagttgtaaactttacgtgggttgggttcgggtacttacgttttaccgtccgggttaacccccgggttggggggttacccccgggtaacccttggggtaacccctccccggtccccttacccccgtaaccccgttcccgaaaccccggg

SEQ ID NO: 416159 - DNA, 812 bp, Homo sapiens
  misc_feature: GZ8MTXP01AKXCR.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtcggggtcccgccgaggcctccgagggggaacgggccgtagggaggtggattctactactttaatttagtaggtggtacggtaccgactataccgtaacaacgaacgtaaccgtcccgggtagggtaaacggggacccgtaatttccaaccctactaccttacgaaacgaaacgaaacctaaactttacccgaaacgggaaacctaaccgtaatttacgttaacttaacctttaaccgtaaaattacggggtaaaacttaaacccgttaggaacggaacggaccccgggaaacgggaacccgaacccgggggtacccctaagttaccggtttaaagtttaacccggttgggtttacgggttacggggggttacctttaacggtttttaacccgtttaccccgggttaccccccggggtttccggggggttacccccgggggtaaacccccggtcggggttaaccccgtacccccggttccccgttacccccccgtaacccccgttaaccccgtaacccccggg

SEQ ID NO: 416160 - DNA, 684 bp, Homo sapiens
  misc_feature: GZ8MTXP01ET7GZ.22.85.H08.1.454.CMB.2.raw
  modified_base (266)..(266): a, c, t, g, unknown or other
  modified_base (293)..(293): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagctctcctgtgcagtctcgtgggttctnagtggcgactacatgagcgtgggtccnccgaggcctccgagggggaacggcctggagtggactcgtctactttatttacgtaggttggtacggtaaccactatacctaacaaacagaaccgtcccgtaaggaacgggcccgtaattccaaacctatctacaagaaagaacaaacttaccgaaacggaaaccactaatttagtaacttacttaactaaacgttagggtaaacttaaacccgtagaacgaacggacccggaaaggaccgaacgggaccctaagttacgttattaacgtggttaggttcgggggtacttaacgtttaccgttccggttaccccggttcgggggaccccgggtaacccgtcggtaaccctacccggtcccttacccccgtaaccccttccccgaaaccccgg

SEQ ID NO: 416161 - DNA, 617 bp, Homo sapiens
  misc_feature: GZ8MTXP01B2SJV.22.85.H08.1.454.CMB.2.raw
  modified_base (407)..(407): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccgtgggggtccctgagctctcctgtgcagtctcgtgggttctcagtggcgactacatgagcgtgggtcccgccaggcctcccggaggggaacgggcctagggacggtgggacttctctactttatttagtagttggtcggtaccatatactacaacagctcgtaggaggccgattcacatctanagaacacaacttacgaaggaacactattagtactcttacaaataggaaactaaccgtgaagacgccgaagactacggctagtacgtattacgtggtggttggggtcttacgttttaccgtcgttaccccggttcggggggaccccgggtaaccccgtgggtaacccaccccggtcccttcccccgtaaccccgttccccgaaaccccggg

SEQ ID NO: 416162 - DNA, 739 bp, Homo sapiens
  misc_feature: GZ8MTXP01EGKBK.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtcctgagactctcctgtgcagtctcgtgggttcgtcgaggtcggcgactacagtgagcgtcgggtccgccgacggccgtccggaagggggacggccgtagggaggtggtacttctactacgttttatttagtaggttggtaccggtaccacgtaacttactaacaacgacgtaaccgtccggtagggaaacgggccgtattacgaacctagtctacgaagaaacgaactaacgttaccgaaaggtaactaactagttacgtaacttaaccttaagtaaaacgttacgggtaaaacttaaacccgtaggaacggaaacggacccggaaacggaccgaaacggtacctaagttacgttaacgttaacgtgggttacgggttggggtacctttaagttacccggttaacccggaccccgggttacgggggttaccccggggttaacccgtccggtaaccccgtccccggtaccccttacccccgtaacccgttaaccccgaaccccggg

SEQ ID NO: 416163 - DNA, 631 bp, Homo sapiens
  misc_feature: GZ8MTXP01EQNQE.22.85.H08.1.454.CMB.2.raw
  modified_base (361)..(361): a, c, t, g, unknown or other
  modified_base (471)..(471): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagacgtggaggaggcttgatccagccgtgggggtccctgagactctcctgtgcagtctcgtgggttctcagtggcgactacatgagcgtcgggtccgcgaggcctcgagggggaacggctgggagtggattctctactttattagtagtggtacgtaccanatactacaacagctcgtagaacgggcctattcactatctacaagaagactaattcccgaaaggaactactattagtaactacttaacaaaattcggaaaacttaaaccgnggaacgacgaccggaagaccgacgtctagttgtaacttggtggttgggttcggtactttacgtttaccggtcccgggaccccgggttgggggaccccgggtaaccttcggtaacccctaccccggtccccacccccgtaaccccgttaacccgaacccgg

SEQ ID NO: 416164 - DNA, 731 bp, Homo sapiens
  misc_feature: GZ8MTXP01CXXC9.22.85.H08.1.454.CMB.2.raw
  modified_base (544)..(544): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcttgggttttccttgttgctatttcaaaaggtgtccagtgtgaggtgctagttggtggagacgtggaggaggcttgatccgagccggtgggggtccctgagactctcctgtgctagtctcgttgggttcgtcgaggtggacgactacatgagtcgtcgggtcccgccgaacggtcctaccggaagggggaacgggcccgttagggaggtggtaacttcctactaacttttagtttaagtaggttcggttaccgtaacctacaattaaccctaacaaacgtaacgtaaccgttacccgggtagggaaacggggtcccgtaatttacccaacctattacctacaaggaaacgaacctaaacttacccgaaaggtaaactaactatttataacttaccttaanaaagtacggtaaactaaccgtagacggacgaccggaacgacgaccggacctagtagttacgttaacgtggttcggttacggggtacttacgttttaaccgtccggttaccccgggttcgggggaccccgggtaacccgtcggtccctacccggtccccttcccccgtaacccgttccccgaacccgg

SEQ ID NO: 416165 - DNA, 803 bp, Homo sapiens
  misc_feature: GZ8MTXP01BCWLT.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccgagccgtgggggtcctgagctctctgtgcagtctcgtgggttcgtcagtggcgactacatgagcgtcggggtcccgccgacgggcctccggaagggggaacgggcccgttaggggaggtggtacttcttacgtaacttttaagtttagtaggttcgggttaccggttaaaccccactaacttaaccgtaaaccaaccgaacgtaacccgttcccgggtaaagggaaaccgggggtcccctaaatttcccaaacccgtattacccttaacgaaacggaaacgaacctaaacgttacccgaaaacggaaacctaacctaatttacgtaacttactttaacaaaagttacgggtaaacttaaacccgtagacggaacggaccggaacggaacccgacgggtacctaagttaccgttaagttaccgtaagggttgggttcgggggtacttaacggtttaccgttcccgggaacccccggggttcggggggttacccccggggtaaccccggttccgggtaaccccggtaccccggttaccccgttacccccccgtaaccccgttaaccccgtaaacccccgggg

SEQ ID NO: 416166 - DNA, 733 bp, Homo sapiens
  misc_feature: GZ8MTXP01CEP66.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgaggggagggcctggagtggatctctactttatttataggtggtcgtaccactatactacaacagaacctccgtaggaacggggcccgaattccgaaccattcctaccaaaggaaacgaacctaaatttcccgaaagggtaaaccaactaatttgtaacttactttacaaaattaggggtaaacttaaacccgttggaaaggaacgaccccggaaagggaaccgaaccggggaccctaaagttagttaacgtttaaccgttgggttgggttcgggggtaccttaaacggtttttaaaccgtttccggggaaccccccgggttggggggggggacccccccgggggttaaacccgttcggggttaaccccgtaaccccggggtttccccttaccccccccgtaacccccgttaacccccgaaaacccccgggg

SEQ ID NO: 416167 - DNA, 620 bp, Homo sapiens
  misc_feature: GZ8MTXP01BI479.22.85.H08.1.454.CMB.2.raw
  modified_base (296)..(296): a, c, t, g, unknown or other
  modified_base (524)..(524): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccgaggcctccgaggggaacggcctgggagtggatctctactttattataggtggtacggttaccactataacctacaacagtctcccgtaggaaggggtccgattcacattcacaagaagactaattccgaaggaactactattagttaacttacttactaaaataggggtaaacttaaacccgtagagacgcccggaaggaccaacgggcctagtgttaattacgngtaggttggggcttagtttacgtccgacccggttcgggggcccgggtaaccgtcgggcctacccggtccttcccccaacccgttcccgaaccccgg

SEQ ID NO: 416168 - DNA, 614 bp, Homo sapiens
  misc_feature: GZ8MTXP01ER341.22.85.H08.1.454.CMB.2.raw
  modified_base (173)..(173): a, c, t, g, unknown or other
  modified_base (276)..(276): a, c, t, g, unknown or other
  modified_base (278)..(278): a, c, t, g, unknown or other
  modified_base (280)..(280): a, c, t, g, unknown or other
  modified_base (315)..(315): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcgtggtttcgtgtaggctattacaaaggtntcagtgtgaggtgcagttggtggagacgtgggaggaggcttggatccgagccgtgggggtcctgagctctctgtgctagtctctgggttctcagtggcactanangngtcgtcggccacgacggcgacggaggggacggcgnggagtgtatctactattattatagtgtacgtacacactactacaacacgcgtacgtacgacgacgtactacactactactacaagaacgaacaactacgaacgaactaactatatactactaactaataacgtaaactaacgtagacgacgacgacggacgacgacgtagtacgtacgttagtaagtggttaggtacgttacgttacgttaccggttacccgggttccggggttaccgggtaacccggtaccgtaaccgtacccgtcccgttacccctaacccgttaacccgtaacccg

SEQ ID NO: 416169 - DNA, 432 bp, Homo sapiens
  misc_feature: GZ8MTXP01AVBIY.22.85.H08.1.454.CMB.2.raw
  modified_base (421)..(432): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgaccccgtggggccggggaacctggtcaccgtctcccaccctccacaggccatctgtccttcccctggccaccctccctccaagacgcacctcgtcgggggcacgagccggcctgggctgcctcggtcaaggactacttccaacgcgtaatgtctggacgcgggcgtgggcaaggcgcatagnnnnnnnnnnnn

SEQ ID NO: 416170 - DNA, 601 bp, Homo sapiens
  misc_feature: GZ8MTXP01EZOZP.22.85.H08.1.454.CMB.2.raw
  modified_base (361)..(361): a, c, t, g, unknown or other
  modified_base (370)..(370): a, c, t, g, unknown or other
  modified_base (378)..(378): a, c, t, g, unknown or other
  modified_base (393)..(393): a, c, t, g, unknown or other
tcagacatacgcgtcacgaccggtgctcgatttagtatcactcagtcgcgggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctaccgaggggaagggcctagggagtggatctctactttattagtagtggtcgtaccanatacacaanagctccgngaacggcgattcacntctacaagaacacaattccaaggaacactattgtatcttacaaataggaactaaaccgtgaacgacgccgagacgaccggactagtgtacttacgtggtggttggggaccttagtttaaccgttccgaaccccgggttgggggaccccgggtaacccgtggtcccgtaccccgtcccgttacccccaacccgttccccgaaacccggg

SEQ ID NO: 416171 - DNA, 737 bp, Homo sapiens
  misc_feature: GZ8MTXP01BK606.22.85.H08.1.454.CMB.2.raw
  modified_base (306)..(306): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcaggttggtggagacgtggaggaggcttgatccagccgtgggggtccctgagactctcctgtgcagttctcgttgggttcgtcgaggtggcgtactacagtgacggcgtcgggtcccnccgacggccgtacccggagggggacgggtccgtagggacggtggtacttccgtacgttaactttaagtttagttaggttcgggttaccggtaaccctacgtaactaacctaaccgaaacgaacgtaaccgtccgggtaacgggaacgggacccgtaacttaccgaacctacttaccgtaacaaacggtaaacgactaaacgtttacccgaaaaggtaccttaaagtacttttagaactttacttaaactaaaagtagggtaaaaccttaaccggagaacgacgacccggaggtaccaaccgggctaagttagttaactcggtaagtcgggttagggctttaacgttaccggtcgacccccgggttgggggacccggtaacctcgggtcccctaaccggtccccttacccccgaaccgttcccgaaacccgg

SEQ ID NO: 416172 - DNA, 569 bp, Homo sapiens
  misc_feature: GZ8MTXP01AC0NP.22.85.H08.1.454.CMB.2.raw
  modified_base (293)..(293): a, c, t, g, unknown or other
  modified_base (356)..(356): a, c, t, g, unknown or other
  modified_base (463)..(463): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttctcagtggcgactacatgagcgtgggtccnccaggctcccgagggggaagggcctggagtggatctcactttatttatagtggtcggtaccanatactacaacagctccgtagaaagggccgattcacatctcaagaagacaattcaaggaacacattgatcttagaaatggaataactgagagccgaggacacggcctntgtattactgtggttggggcttagtttactggaccccgttgggggaccccggggtaaccctgggtccaacccggtccttaccccctaaccccttcccgaaacccgg

SEQ ID NO: 416173 - DNA, 724 bp, Homo sapiens
  misc_feature: GZ8MTXP01EEJHA.22.85.H08.1.454.CMB.2.raw
  modified_base (302)..(302): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtcctgagactctcctgtgcagtctcgtgggttcgtcgaggtggcgactgcatggagtcgtcgggtcccnccgaggcctccggaggggaacggccgtggagtggatctactactttattagtaggtcggtacggtaccatatacctaaacaacaagacgtcccggtaggaacgggtccgtattcaacctatctacgaagaacgaactaaacgttacccgaaaggtaaacctaacgtattacgtaacttactttaaacaaaatttacggtaaaactttaacccgtaggaaacggaaccgacccgggtaacgggaaaccttacccggggaaccttaagtttacgttaaccgtttaacggtcggttagggggtcggggttaacttaacggttttacccggttacccgggccccgggtttaggggggaacccccgggtaaccttcggggttaccccaacccgggttccccctaacccccgaaccccgtaaccccgg

SEQ ID NO: 416174 - DNA, 737 bp, Homo sapiens
  misc_feature: GZ8MTXP01BETH4.22.85.H08.1.454.CMB.2.raw
  modified_base (362)..(362): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtcccgcgaggcctccggaggggacggccgtggagtggatctactactttattagtaggtggtcgtaccanatacctacaaacacgtccgtccggtaggaacgggccgtattccaacctataccctacaaaggaaacgtaacctaaagtttaccccgaaagggtaaaccctaacgttaacgttttaggttaaacttaccctttaaacgtaaaattacggggtaaaactttaaaccccggtaaggaaacgggaaccggacccggaaagggacccgaaccggtaccctaagttaggttaaacttttacggtgggttagggttcgggggtactttaacgttttaccggtaccggacccccggggttcggggggaccccggggtaaccccttggggtaacccctaccccgggtcccttacccccccgccccgttaaccccgaaccccggg

SEQ ID NO: 416175 - DNA, 693 bp, Homo sapiens
  misc_feature: GZ8MTXP01EZXAM.22.85.H08.1.454.CMB.2.raw
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtggaggaggcttgatccagccgtgggggtcctgagctctctgtgctgtctcgtggttcgcgagtggcgactacagtgagtcgtcgggtccgccgaggcctcggaggggaacgggccgtgggagtggacttctactactttatttagtaggtggtcgtaccactaatactacaaacacgtaactccggtaggaacgggcctaattccaactatcctacaagaaacgtaactaaacttcccgaaaggaaacctactagttagtaacttaccctaaataaaagttacgggaaaacttaaacccgtggaaacggaccggaccggaacggaaccacggggacctaagtacgttaacttacggtgggttagggttcggggtactttacgttttaccgggtaccgttacccccggggttgggggacccccgggggtaaccctccggggtaacctaccccggtccccacccccgtaaccccgttcccgaaaccccgg

SEQ ID NO: 416176 - DNA, 566 bp, Homo sapiens
  misc_feature: GZ8MTXP01CGY0M.22.85.H08.1.454.CMB.2.raw
  modified_base (366)..(366): a, c, t, g, unknown or other
  modified_base (400)..(400): a, c, t, g, unknown or other
  modified_base (402)..(402): a, c, t, g, unknown or other
  modified_base (430)..(430): a, c, t, g, unknown or other
  modified_base (443)..(443): a, c, t, g, unknown or other
  modified_base (450)..(450): a, c, t, g, unknown or other
  modified_base (465)..(465): a, c, t, g, unknown or other
  modified_base (472)..(472): a, c, t, g, unknown or other
  modified_base (477)..(477): a, c, t, g, unknown or other
  modified_base (543)..(543): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgctagtctcgtgggttcgtcgagtggcgactacatgagcgtcgggtccgccgaggctccggaggggacgggccgtggagtggattctctactttatttagtagtggtcgtaccanatactacaacagctcgtgaacgggcatcacatcnanaagacaattccaagacatatatatctanaaatgaaactacngaagacncgagacacgctagtntattagngtggngggtcttacgtttacgtcggacccggttgggggaccccggaacttcggggtaaccctcccggtccncccctaacccgttccgaacccgg

SEQ ID NO: 416177 - DNA, 616 bp, Homo sapiens
  misc_feature: GZ8MTXP01D8J0X.22.85.H08.1.454.CMB.2.raw
  modified_base (294)..(294): a, c, t, g, unknown or other
  modified_base (339)..(339): a, c, t, g, unknown or other
  modified_base (355)..(355): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcagtggcgactacatgagctgggtccncaggctccgaggggagggcctggagtggattctctactttattanagtggtacggtaccanatactacaacagctccgtagaaacggggccattccactatctagaagaacgacaattacccgaaggaaaccatattagtaattacttaacaaattagggaaacttaaccgtgaacgaggacccggaaggaaccacgggtacctaagttacgtaatttacgtggtgggttaggggtcttacgttttacgtcggacccccggttgggggacccgggtaaccctggtccacccggtccttaccccgaacccttcccgaacccgg

SEQ ID NO: 416178 - DNA, 716 bp, Homo sapiens
  misc_feature: GZ8MTXP01ADMJ5.22.85.H08.1.454.CMB.2.raw
  modified_base (296)..(296): a, c, t, g, unknown or other
  modified_base (360)..(360): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccnccgaggctccgaggggaacggcctggacgtggatctcgtactttattatagtggtacgtaccanatactacaacagctcgtaggaacgggccgtattcactatctacaagaacgacaacttacccgaaaggaacctaactatttagtaacttacttaacgaaaagttcgggtaaaacttaaaccgtaggaaacggaaccggaccccggaaagggaacccgtaaccgggaccctaagttacgttaaagtttaccggtaagggttggggttacgggggtacctttaaacgttttaacccggttccgggttaaccccccgggttcggggggggttacccccggggtaaccccgttcgggttaaccccgtaaccccgggttcccccgttacccccctaaccccgttccccgtaaacccccgggg

SEQ ID NO: 416179 - DNA, 657 bp, Homo sapiens
  misc_feature: GZ8MTXP01CCIHO.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgagtggcgactacatgagcgtgggtccgccgaggctccgaggggaagggcctggagtggatctcgtacttattatagtggtcgtacatatactacaacagctccgtagaacgggcgatcacatctacaagaacgacaacttccgaaaggaaacacgtattagtacttacttaacaaattagggtaaacttaaaccgtgaagacggacccggaaggaaccgacgggaccctaagttagttagttaccgttggtgggttcgggggtacttacgttttaacgttccgggttaacccccggttggggggttacccccggggtaaccccgtcgggggttccctaccccgggttcccttaccccccgtaaccccgttccccgaaacccccggg

SEQ ID NO: 416180 - DNA, 552 bp, Homo sapiens
  misc_feature: GZ8MTXP01AV42U.22.85.H08.1.454.CMB.2.raw
  modified_base (273)..(273): a, c, t, g, unknown or other
  modified_base (350)..(350): a, c, t, g, unknown or other
  modified_base (481)..(481): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggngactacatgagctgggtccgccaggcctccgaggggaggcctggagtggatctcacttattatagtggtcgtaccanatactacaacagctccgtgaagggccattcacatctcagaagacaattccaggaacactattgtactcttacaaatggaaataaccgtgaagagccgaggacacggcctatgtattacgtgtggttggggnagtttactcggaccccgttgggggcccgggaacctggtccaccggtccttccccaacccttccgaacccgg

SEQ ID NO: 416181 - DNA, 567 bp, Homo sapiens
  misc_feature: GZ8MTXP01DAO1M.22.85.H08.1.454.CMB.2.raw
  modified_base (355)..(355): a, c, t, g, unknown or other
  modified_base (392)..(392): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggtccgccaggctccgaggggaaggcctggagtggatcgtctactttatttatagtggtcgtaccanatactacaacagctcgtagacggccgatcacatctanagaagacaattaccaaggaacactattgtatcttacaaatggtaaactaaccgtagagacgcgagacacggctatgtattcgtgtggttgggcttagtttacgtcggaccccgttggggacccgggtaacccgtcgtccgtacccgtccttaccccctaacccgttccgaacccg

SEQ ID NO: 416182 - DNA, 598 bp, Homo sapiens
  misc_feature: GZ8MTXP01AT2D9.22.85.H08.1.454.CMB.2.raw
  modified_base (376)..(376): a, c, t, g, unknown or other
  modified_base (410)..(410): a, c, t, g, unknown or other
  modified_base (454)..(454): a, c, t, g, unknown or other
  modified_base (493)..(493): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgaggccgtgggggtccctgagactctcctgtgcagtctcgtggggttcgtcgaggtggcgtactacagtgagcgtcgggtcccgccgaggcctaccggagggggaacgggccgtgggaggtggactctctactttattagtagtggtcgtacanatactacaacagctcggtagaacgggcatcactntactacagaacactaattccgaagactactattcgtatacttanaaatgaaactaacgtgaacgacgacgagacgacgacctntagtactgtgtggttgggtacttacgtttacgtccggacccggttcggggacccgggtaaccctggtccctcccgtcccgttacccctaacccgttcccgaaccg

SEQ ID NO: 416183 - DNA, 688 bp, Homo sapiens
  misc_feature: GZ8MTXP01CBNHI.22.85.H08.1.454.CMB.2.raw
tcagacatacgcgtcacgaccggtgctcgatttagtatcactcagtcgcggggggggagaggagcccagcactgggattccgaggtgtttccattcgttgatcagcactgaacacagaggactcaccatggagttttggctgagcttgggttttccttgttgctatttcaaaaggtgtccagtgtgaggtgcagttggtggagacgtggaggaggcttgatccagccggtgggggtccctgagctctcctgtgctagtctcgttgggttcgtcgaggtggcgactacatggagtcgtcggggtcccgccgacgggccgtacccggaagggggaacggggccgtagggacggttggaacttctacttactttaatttagtaggtgggttaccggtaccactactaacctacaaactacgccttaccggtagggaacgggtccgtattaccgacctatctacaaggtaacgacaaacttacgaacggtaaactactacttagtaacttacttaacaaaagttacggaaacttaaccgtaaggaacggacgaaccggaaggacccgaccggacctagtacgttaatttcgtaaggttggttacggggtcttacgtttaacgtcggacccgggttcggggacccgggtaacctcggcctacccgtcccaccccgtaaccttcccgaacccgg

SEQ ID NO: 416184 - DNA, 805 bp, Homo sapiens
  misc_feature: GZ8MTXP01DUIIS.22.85.H08.1.454.CMB.2.raw
  modified_base (295)..(295): a, c, t, g, unknown or other
tcagacatacgcgtcacgaccggtgctcgatttagtatcactcagtcgcgggggggagaggagcccagcactgggattccgaggtgttcccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcgagtggcgactacatgagcgtgggtccncgaggcctccgaggggaacggtccgtggacgtggacttctcgtactttatttagtaggttacgggtcggttaacccaactaattaacccttaacaaaacccgtaacggtaaccgttaccccggggttagggaaaaccgggggccccgtaacgtttacccgaaaccccgtaacgttacccttaacccgaaagggtaaaacgaaacctaaacgtttaaaccccgaaaacgggaaaaccctaaccgtaaacgttttagtaaactttacctttaaaccttaaaattaacggggtaaaactttaaacccggttaagaaagggtaacggaaccccggtaacgggaacccgaaaccggggtacctaagttacggtttaaattaccggttaagggtggttagggggtacttacgttttaacgttccggttaccccgggttcgggggttacccggggtaaacccgttcggtcccgtacccggtcccttacccccgtccccgttaacccgaaaccccggg

SEQ ID NO: 416185 - DNA, 706 bp, Homo sapiens
  misc_feature: GZ8MTXP01AX4YA.22.85.H08.1.454.CMB.2.raw
  modified_base (667)..(667): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgaggtggcgactacagtgagtcgtcgggtccgccgaggcctccggagggggaacgggccgtgggaggtggacttctactactttatttagtaggttggtaccggtaccacgtataacctacaaacgacgtaaccgtaccggtagggaaacggggtccctacgtttccaaccgtacttacctacgaaaggtaaacgaactaaacgttcccgaaaggtaacctaactatttagtaacttacttaaactaaaattacggggaaaacttaaacccgtaggaacgaacggacccggaaggaacccgaacggcctaaagttcgtaaatttcgtggttacggttgggtacttagtttaccgtcggttaccccgggttgggggccccggtaacccgtcggtaacccncccggttccccaccccttaaccccgcccgtaaacccggg

SEQ ID NO: 416186 - DNA, 544 bp, Homo sapiens
  misc_feature: GZ8MTXP01ANCMG.22.85.H08.1.454.CMB.2.raw
  modified_base (341)..(341): a, c, t, g, unknown or other
  modified_base (389)..(389): a, c, t, g, unknown or other
  modified_base (392)..(392): a, c, t, g, unknown or other
  modified_base (530)..(530): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaacggcctggagtggatctcgactttattanagtggtcgtaccatatactacaacagctccgtgaagggccattcaccntcncagaagacaattccaggaacactattgtatcttacaaatggaaatacctagagagccgagacacggctatgtatactgtgttggggcttgttactcgacccgttgggacccgggaacctcggccaccgtccttccccncccttccgaacccg

SEQ ID NO: 416187 - DNA, 640 bp, Homo sapiens
  misc_feature: GZ8MTXP01EGXBW.22.85.H08.1.454.CMB.2.raw
  modified_base (367)..(367): a, c, t, g, unknown or other
  modified_base (404)..(404): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtggaggaggcttgatccaggccgtgggggtccctgagactctcctgtgcagtctgtgggttctcgagtggcgactacatgagcgtgggtcccgcgaggctccgaagggggacggccgtggagtggattcgtactactttattagtaggtggtcggtaccanatactacaacagctcgtagaacggcatcactatctanaagaacgactaacttcgaaagaacactattgtaacttacttaataaatagggtaaacttaaccgtagaagacgaccggaagaccgaacggctaagttaggttacttcgtaagggttgggttcggggtactttacgtttaccgttccgggaacccccgggttgggggaccccgggttaaccctgggtaaccccacccggttccccttacccccctaacccgttcccgaacccccggg

SEQ ID NO: 416188 - DNA, 693 bp, Homo sapiens
  misc_feature: GZ8MTXP01BN4E9.22.85.H08.1.454.CMB.2.raw
  modified_base (294)..(294): a, c, t, g, unknown or other
  modified_base (353)..(353): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccncgaggctccgaggggacggcctggagtggatctctacttattagagtggtacgtaccanatactacaacagctccgtagaacgggcctattcaacatctacgaagaagactaacttaccgaaaggaactaactattagttaacttacttaactaaaagttacggggaaacttaaacccgtggaaacggaacggacccgggaacggaaccgaacccggggacctaacgttacggttaatttaaccggttgggtttcgggttaggggggtaccttaacggtttttaccgttccgggttaaccccccgggttcggggggttaccccgggggtaaccccggttcggggtaacccgtaccccgttccccgttacccccctaaccccgttccccgaaaccccggg

SEQ ID NO: 416189 - DNA, 660 bp, Homo sapiens
  misc_feature: GZ8MTXP01B4MSY.22.85.H08.1.454.CMB.2.raw
  modified_base (363)..(363): a, c, t, g, unknown or other
  modified_base (407)..(407): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccagccgtgggggtccctgagactctcctgtgctagtctcgtgggttcgtcaggtggcgactacatgagcgtgggtcccgcaggcctaccgaggggacgggccgtgggagtggatctctactttattatggtggtcggtaccanatacctacaacagcgtccgtagaacgggcctagttcacatctanaagaagacaacttccgaaggaacactattcgtattctacaaattacggtaaactaaccgtagagacggaccgaaggaccaacgggcctaattacggttaacttaacggttggtagggttcgggggtactttacgttttaaaccggttccggttaacccccggggttcggggggttacccccggggtaacccgttccgggtcccgtaaccccggttccccttacccccgtaaccccgttccccgaaaccccggg

SEQ ID NO: 416190 - DNA, 749 bp, Homo sapiens
  misc_feature: GZ8MTXP01BGYB1.22.85.H08.1.454.CMB.2.raw
  modified_base (242)..(242): a, c, t, g, unknown or other
  modified_base (626)..(626): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcttgggttttccttgttgcttatttacaaaaggtgtccagtgtgaggtgctagttggtggagacgtggaggagcttgatcgagccgtggggtcctganactctctgtgcagtctcgtggttctcgaggtgcgactacagtgagcgtcgggtccgcgaggcctaccggaggggaacgggccgtgggaggttcggacttcgttaccttaagttttaagtttaagtaggttacggttaccggtaaccctaactaaacttaacccgtaacaaaaccgtaacgtaacccgttaccgggtagggaaaccggggtacctacttacccaacctactaccgtaccaaaggaaactactaaaccttaccgaaacggaaactaactatttacgttaacttacttaaactaaagtaacgggtaaaacttaaccgtaagaacggaacggtacccggaaggaacccgaaccggtacctagttacgtagttaacggnggttacgggttggggtacttacggtttaccgttccggaccccggggttcgggggaccccggtaacccgtcggtaaccctacccggtccccttaccccctaacccgttaacccgaaaccccggg

SEQ ID NO: 416191 - DNA, 835 bp, Homo sapiens
  misc_feature: GZ8MTXP01AFLV5.22.85.H08.1.454.CMB.2.raw
  modified_base (260)..(260): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgactccaggtccgtcggggggtccctgacgactctcctgtcgcngtctcgtgggttcgtcgaggtggctactacagtgagtcgtcgggtccgccgaggccgtaccggaagggggacggcgtagggagtggactcttctactttaagtttacgtaggtcggtaccggtacctacgtaacttaaccaccgaaaacgtacgtaaccgttaccgggtaagggtaaaccggggtcccgtaatttacccaccgtacttcctaaccgaaaggtaaacgaaaccttaaacgttacccgaaaagggtaaacctaccttaagtttacggttaacttaacctttaaacgaaaaattacggggtaaaaacttaacccggtagggaaacggtaaccgggacccgaaacggaaacccggtaaccgggaccttaaaggtttacggttaaactttacgggttggttcgggggttacggggttactttaaacccgtttttccccgggtaaccggggacccccccgggggttcgggggggttaaccccccgggggtaacccttccgggtaacccccttaacccccgggtcccctttacccccccggaaccccccgttaacccgtaaaacccccgggg

SEQ ID NO: 416192 - DNA, 599 bp, Homo sapiens
  misc_feature: GZ8MTXP01B49FM.22.85.H08.1.454.CMB.2.raw
  modified_base (358)..(358): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtccgccgaggctcccgaggggacggccgtggagtggatctctacttattatagtggtcgtaccanatactacaacagctcgtagacgggccgattcactatctacaagaacgactaacttaccgaaggaacactattgtaattcttacaaataggaaactaaccgtgacgacgaccgaggacgacggcctagttagtattcgtggtggttggggtcttagtttaccgtcggaccccggttgggggacccgggtaacccgtgggtcccctaccggtcccttcccccgtaacccttcccgtaacccgg

SEQ ID NO: 416193 - DNA, 636 bp, Homo sapiens
  misc_feature: GZ8MTXP01ENZSA.22.85.H08.1.454.CMB.2.raw
  modified_base (319)..(319): a, c, t, g, unknown or other
  modified_base (365)..(365): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcgttgggttttccttgttgctatttacaaaaggtgtccagtgtgaggtgcgtaggttggtggagacgtgggagggaggcttgatccgaggccggtggggggtccctggacgtactctccgtgtgctagttctcgttggggttcgtcgaggtggcgactacatgagcgtgggtccncgaggctccgagggggaacggctgggagtggatctctatttattanggtggtacgtaccatatactacaacagtcgtcgtaggaacgggcctattcactatctacaagaagaactaattaccgaaggtaacaactattagttactacttaactaaataggaaacttaaccgtagagacgaccgacggacaacggctagttagtacttaacgtggtgttggggtacttacgtttacgttccggacccggttcgggggttacccggggtaacccgtcggtcctaccccggtcccacccctaacccgttcccgaacccgg

SEQ ID NO: 416194 - DNA, 892 bp, Homo sapiens
  misc_feature: GZ8MTXP01BEE5D.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgactccagccgtgggggtccctgagactctctgtgcagttctcgttgggttcgtcgaggtggcgactacatggagcggtcgggtcccgccgaggccgtacccggaagggggaacggggccgtagggacggtggtaacttcctactacttttaagtttagtaggttgggttacccggtaacccactaacttaacctaaccgaaaccgtaaacggtaacccgttacccgggtaaggggtaaaccggggtaccccgtaacgtttacccaaaccccgtaagtttaccctaacccgaaaaggggtaaaaccgtaaacctaaaacgtttaccccgaaaagggtaaaacccctaattaacggtttaacgttaaactacctttaaactaaaaacgttacggggtaaaactttaaaccccggtggaaaaccggacggtaaccccggggaaagggtaacccgtaaaaccccggggccttaaacggtttaacggttaagttttaaaccgggtcgggtttagggggttaccgggggtaccctttaaacggtttttaaccccgggtaccgggttaaaccccccgggggttggggggttaaccccccgggggttaaacccgtcgggttaaccccggtaccccggttccccttaccccccccggtaacccgttaaccccgaaacccccggg

SEQ ID NO: 416195 - DNA, 596 bp, Homo sapiens
  misc_feature: GZ8MTXP01DRM4I.22.85.H08.1.454.CMB.2.raw
  modified_base (407)..(407): a, c, t, g, unknown or other
  modified_base (564)..(564): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggttgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtcccgccgaggcctccgaggggaagggcctgggagtggatcttctactttatttatagtggtcgtacccacatactacacaagactccgtagaacgggccatcacatctcagaanacaattccaaggaacactattgtattactacaaatgaaactaaccgtgaacgaggcccgaaggacacggctatgtatacgtgtggtgggacttattttacgtccggaaccccggttcggggggcccgggttaacccgtgggtaccctcccgttcccncccccgacccctcccgaacccgtaaccccggg

SEQ ID NO: 416196 - DNA, 652 bp, Homo sapiens
  misc_feature: GZ8MTXP01AEAV4.22.85.H08.1.454.CMB.2.raw
  modified_base (296)..(296): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctggggttctcgagtggcgactacatgagcgtgggtccnccaggctccgaggggaacggcctggagtggatctcgactttatttagaggtggtcggtaccacagtacctacgaactagaacctccgggtagaaacggggcctattcaaacctactcttacgaaggtaacaacctaaagttcccaaggaaacactattagtatactttacgaaatggaaataacccgtgaacgagccggagaccgacggtacctagtcggtattaccgtggtaaggttcgggggtacttacgtttaaccgttccgggaaccccggttcgggggttaccccggggtaacccttcggggtccctaacccgggtccccgttcccccgaaccccttcccgaaaccccggg

SEQ ID NO: 416197 - DNA, 738 bp, Homo sapiens
  misc_feature: GZ8MTXP01DV3DP.22.85.H08.1.454.CMB.2.raw
  modified_base (302)..(302): a, c, t, g, unknown or other
  modified_base (369)..(369): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgctagtctcgtgggttcgtcaggtggcgactacatgaggctcggggtcccnccgaggctccgaggggacgggcctggagtggattctacgtactttatttagaggtggtcggtaccanatactacaacagtctcgtagaacgggcctattcactatctcaagaagactaattacccaaaggaacactattagtactacttaacaaaagttaggtaaacttaacccgtaggaaacggaacggacccggaagggacccgaacgggtaccctaagttacggttaattaccggttgggtttaggggttacggggggttaaccctttaacgtttttaaacccggttacccggggttaaccccccccggggtttcggggggggggacccccgggggttaaacccccggtttcgggttaacccccggtaaccccccgggttccccttaacccccccccgggtaaccccttaacccccggtaaaaccccccgggg

SEQ ID NO: 416198 - DNA, 575 bp, Homo sapiens
  misc_feature: GZ8MTXP01EGM59.22.85.H08.1.454.CMB.2.raw
  modified_base (361)..(361): a, c, t, g, unknown or other
  modified_base (401)..(401): a, c, t, g, unknown or other
  modified_base (425)..(425): a, c, t, g, unknown or other
  modified_base (489)..(489): a, c, t, g, unknown or other
  modified_base (553)..(553): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgagggggaacgggcctgggagtggattcgtctactttattagtagtggtcggtaccanatactacaacagctccgtagaacgggccattcactatctnagaagacaattcccaaggaaccanattagtatacttacgaaatggaaataaccgtgaagagaccaggacacggcctagtgtattacgnggtggttgggcttagtttacgtcgacccggttgggggacccgggtaacctggtccacccggtcncccctaacccgttcgaacccgg

SEQ ID NO: 416199 - DNA, 602 bp, Homo sapiens
  misc_feature: GZ8MTXP01BMDFC.22.85.H08.1.454.CMB.2.raw
  modified_base (359)..(359): a, c, t, g, unknown or other
  modified_base (402)..(402): a, c, t, g, unknown or other
  modified_base (406)..(406): a, c, t, g, unknown or other
  modified_base (441)..(441): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtggggggtccctgagactctcctgtgcagtctcgtgggttcgcaggtggcgactacagtgagcgtgggtccgcaggctccgaggggaacgggcctggagtggatctcactttattatagtggtacgtaccanatactacaacagaactcgtaggaacgggcctattcacatctanaganacgaattcaacggaacactagttatactacttaanaaataggaaactaactagacgacgccgaggacaccggctatgtacttcgtgtggttggggtacttagtttacgtccggccccggttcgggggccccggggtaaccccgtcgggtaacccaccccgttccgttaccccctaaccccgttccccgaaccccgg

SEQ ID NO: 416200 - DNA, 652 bp, Homo sapiens
  misc_feature: GZ8MTXP01B8Q2J.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctctgggttcgtcagtggcgactacagtgagcgtcgggtccgcgaggctccgaggggagggcctggagtggatcgtctacttatttataggtggtcggtaccatatactacaacacgcgtccgtagaacgggccgattccgacatctacaagaacgactaattcccgaaggaacctataatttgtaacttacctttaacaaaagttgggtaaaacttaacccgttagaaacggtaacggacccggaggaaccaaccgggcctaagtaggttaacttacgtggtgggttcggggtacttagttttaaaccgtcgggttaacccccggttgggggaccccgggtaaccctggttcccgaccccggtcccacccccggtaaccccttcccgaaccccggg

SEQ ID NO: 416201 - DNA, 609 bp, Homo sapiens
  misc_feature: GZ8MTXP01BNGRT.22.85.H08.1.454.CMB.2.raw
  modified_base (373)..(373): a, c, t, g, unknown or other
  modified_base (408)..(408): a, c, t, g, unknown or other
  modified_base (452)..(452): a, c, t, g, unknown or other
  modified_base (529)..(529): a, c, t, g, unknown or other
  modified_base (589)..(589): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctccgtgtgctagttctcgtgggttcgtcgaggtggcgactacagtgagcgtcgggtccgccgaggccgtaccggaggggaacggccgtaggagtggactctctactttattatagtggtaccgtacanatacacaacagctcgtagacggcctatcacatcanaagaagacaacttccgaagaactacgtattagtacttacttaanaaataggtaaaacttaaccgtagaacggacgccgaacggacgaaccggtctaagttacgttattacggtgttcgggngggtacttacgttaccgtcggacccggttggggacccggtaaccgtcgcctacccgtccncccctaaccttcccgaaccg

SEQ ID NO: 416202 - DNA, 615 bp, Homo sapiens
  misc_feature: GZ8MTXP01DMSAT.22.85.H08.1.454.CMB.2.raw
  modified_base (403)..(403): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtccgccgaggcctaccgagggggaacgggccgtggagtggactctctactttattagtgtggtcgtaccatatactacaacagtctcgtagacgggcctatcacatctanagaagactaattaccgaaaggaacactattagtacttacttaacaaatacggaaactaaccgtagaagacgaccgaaggaaccacggcctagttagtaacttcgtggttgggttggggtacttacgtttacgtcggaccccgggttcgggggacccgggtaacccgtcggtcccacccgtccccgaccccctccccgaacccgtaaccccgg

SEQ ID NO: 416203 - DNA, 620 bp, Homo sapiens
  misc_feature: GZ8MTXP01DPX61.22.85.H08.1.454.CMB.2.raw
  modified_base (416)..(416): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtggaggaggcttgatccgagccgtgggggtccctgagactctcctgtgcagtctcgtgggttcgtcgagtggcgactacatgagcgtcgggtccgcgaggctccgaggggacggccgtggagtggattctactactttatttagtaggtcggtacggtaccactatacacaacacgcgtcgtagaacgggcgtatacgacatctcaagaanaactaacttaccgaaaggaactaactattagtaactacttaacaaagttacggaaacttaaccgtagaacgacgaccgagaacgtacggctagtcgtattcgtaagtggttcgggtacttacgtttaccgtcggaccccggttgggggaccccggtaaccgtggtccctacccggtcccaccccgtaacccgttcgaaccccgg

SEQ ID NO: 416204 - DNA, 633 bp, Homo sapiens
  misc_feature: GZ8MTXP01AC2UF.22.85.H08.1.454.CMB.2.raw
  modified_base (511)..(511): a, c, t, g, unknown or other
  modified_base (520)..(520): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgacgactctcctgtgcagtctcgtgggttcgtcgagtggcgactacagtgagcgtcggggtccgccgagggcctcccgaagggggaacggggcccgtagggaggtggaattccttacgtactttatttataggtggtaccggtaccatatactacaacagtaactccgtagaacgggtccattcacatctacagaagaacaattccaaggaacactattatatcttacaaatacggtaaataaccgtgaagacgcggacgacgtacggcctagtntacgttagnggtggttcggggtacttacgtttacgtcgaccccggttgggggaccccgggtaacccgtcggtaacccgtacccggtccccttacccccaacccgttaaccccgaaccccggg

SEQ ID NO: 416205 - DNA, 585 bp, Homo sapiens
  misc_feature: GZ8MTXP01DFAWV.22.85.H08.1.454.CMB.2.raw
  modified_base (493)..(493): a, c, t, g, unknown or other
  modified_base (553)..(553): a, c, t, g, unknown or other
  modified_base (568)..(568): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagtcttgggtttttccttgttgcttatttacaaaaggtgtccagtgtgaggtgcagttggtggagacgtgggaggaggcttgatccgagccgtggggggtccctgacgactctcctgtgcagtctcgtggttcgtcagtggcactacatgagcgtcgggtccgccgaggctccgaggggaacgggctggagtggatctctatttattagtagtggtacgtaccatactacacaacagctcgtaggaacgggcgtactcactatctagaagaagacaacttaccgaaaggaactactagttatactactaacaaataggaaactaactagagacgcgaacgacgacgctatntatcgtggtgttgggcttagtttcgtacggcccggttggggacccggtaacgtcggtccncccgtccttaccccncccgttccgaaccccgg

SEQ ID NO: 416206 - DNA, 597 bp, Homo sapiens
  misc_feature: GZ8MTXP01D3REE.22.85.H08.1.454.CMB.2.raw
  modified_base (267)..(267): a, c, t, g, unknown or other
  modified_base (282)..(282): a, c, t, g, unknown or other
  modified_base (372)..(372): a, c, t, g, unknown or other
  modified_base (455)..(455): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtcctgagactctcctgtgcagtctcgttgggttcncaggtggcgactacntgagcgtcgggtccgccgaggccgtccgagggggaacggccgtaggaggtggacttcgtactactttatttagtaggtggtacgtaccanatactacaacagctacgtggaacggccgattcacatcctacgagaagacaattaccgaagaacactattacgtacttccttanaaactaggaaactaaccgtggagacgaccgagacacggccattgtattcgaagtggttagggtcttacgttcgtccgaccccggttgggggcccgggtaaccctggcctacccgtccttaccccctccgttcccgaacccgg

SEQ ID NO: 416207 - DNA, 724 bp, Homo sapiens
  misc_feature: GZ8MTXP01A2PKJ.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctctgtgcagtctgtgggttcgtcaggtgcgactacagtgagtcgtcgggtccgcgaggccgtaccgaggggaacggccgtagggcgtggatcgtactactttatttacgtaagtggtacggtaccacgtactactacaaacgacgtaacctccggtagaaaccggggcctaactttccaaccgtattactacgaaacggtaaacgaactaacttacccgaacggaaaccaacctaagttacgtaacttaccgttaactaaaacttacggggtaaaactaaacccgttaggaacggaacgtaacccggacggaacccgaacgggacccttaagttacggttaaacttaccgttgggtaggttcgggggtaaacttacgtttaaccggtccggttaaccccgggttcgggggttaccccgggggtaacccgttggtaaccccgcccggtacccttcccccgtaacccgttcccgaaccccgg

SEQ ID NO: 416208 - DNA, 822 bp, Homo sapiens
  misc_feature: GZ8MTXP01DMRQV.22.85.H08.1.454.CMB.2.raw
  modified_base (251)..(251): a, c, t, g, unknown or other
  modified_base (367)..(367): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtcagtgtgaggtgcagttggtggagacgtggaggaggcttgatccgagccgtgggggtccctgagactctcctgtncagtctcgtgggttcgtcgagtggcgactacagtgacgctcgggtccgccgaggcctccggaggggaacgggcctgggagtggactcgtactacttattagtagtggtcgtaccanatactacaacgacgaacgttaccgagggaaacgggtccgtaacttccgaacctataccgtacaaacggtaaacgaaactaaacgtttacccgaaaacgggtaaaactaccgttaaagtttacgtaatttaccgttaaactaaaacgttaaggggtaaaacttaaaacccgttaagggaaaggaaccggtaacccggaaacgggtacccgaaaaccgggtcccttaaacggttagttaaacgtttaccggttaacgggttagggggttacgggggttaacccttaaacggtttttaaccccggttacccggggttaacccccccgggggtttcggggggggttaaacccccccgggggttaaaccccgtttacgggttaacccccggtaaacccccgggtttcccccttaaaccccccggtaaccccccccgttaaccccggaaaaccccccgggg

SEQ ID NO: 416209 - DNA, 595 bp, Homo sapiens
  misc_feature: GZ8MTXP01D55NS.22.85.H08.1.454.CMB.2.raw
  modified_base (453)..(453): a, c, t, g, unknown or other
  modified_base (471)..(471): a, c, t, g, unknown or other
  modified_base (505)..(505): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagagtggaggaggcttgatccgagccgtgggggtccctgagactctcctgtgctagtctgtgggttcgtcaggtggcgactacatgagcgtgggtcccgccgaggcgtaccgagggggaacggccgtggagtggattcgtactactttatttagagttggtaccgtaaccatataactacaacagctccgtaggaacggccgattcactactctacaagaacgaataattcccaagaacactattgtatactanaaataggaaataccgtanagagacccgagacgacgctatagtatagtggtgngggtcttagttaacgtcgacccggttggggaccccggtaacctcgggtaaccctacccggtccttaccccgcccgttaacccgaacccgg

SEQ ID NO: 416210 - DNA, 672 bp, Homo sapiens
  misc_feature: GZ8MTXP01A3RU7.22.85.H08.1.454.CMB.2.raw
  modified_base (294)..(294): a, c, t, g, unknown or other
  modified_base (309)..(309): a, c, t, g, unknown or other
  modified_base (450)..(450): a, c, t, g, unknown or other
  modified_base (484)..(484): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggtagttttggctgagtcttgggtttttccttgttgcttatttacaaaaggtgtccagtgtgaggtgctaggttggtggagacgtgggaggaggtcttagactccgacggtccggtcggggggtcccctggacgtactctccgtgtgctagtctcgtgggttcgngaggtcggcgactanagtggagtcgtcgggtccgccgaggcgtaccggagggggacggtcgtgggagtcggacttctacttacgtttattagtaggtggtacccgtaccataactactacaacgagccgtcgtaggacggtcctatcactatcganaagtaacaactaactacaagaacctatacgtttntattaccttaagaaactaggtaaactacggagagacgacgaacgacgcgtactagttacttaacgttgtgggtgttcgggactttacgtttacccgtccgggacccggggttccgggggttaaccccgggttaacctcgggtaaccctccccgtacccgccccctaaccccgttaacccggaacccgg

SEQ ID NO: 416211 - DNA, 781 bp, Homo sapiens
  misc_feature: GZ8MTXP01EC0MW.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtggaggaggcttgatccaggccgtgggggtcctgagctctctgtgctagtctcgtggggttctcaggtggcgtactacgtatggacgtccgtcggggtcccgccgaggtccgtccggaagggggacgggtccgtggtaggttggacttctactacttttatttaagtaggttcggtacgtaacctactactaactaccaaacgacgtaaccgtccggtaggaacggggccctacttaccgacctataccgtacaaacgaaacgtaactaaacgttaccgaaagggtaaccctaagtaacgtttataaccttactttaaacgaaaactttaacgggggtaaaacttaaacccggttaggaaacggtaacggaccccgggaaacggtaaccgaacccgggtaccttaagttaggtttaaacgttaacggttgggttgggttcgggttaaccgtttagtttacccggttacccgggaccccgggggttcgggggttacccccggggtaaaccggttccggtaacccgttccccggttacccccttaccccctaacccccgttaacccgaaaccccgggg

SEQ ID NO: 416212 - DNA, 918 bp, Homo sapiens
  misc_feature: GZ8MTXP01C9WO2.22.85.H08.1.454.CMB.2.raw
  modified_base (308)..(308): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcacgttctcgtgggttcgtcgaggtcggcgactacagtggagccgtcggggtccnccgacggccgtaccggagggggacggtccgtgggagtggacttctactacttttagtttagtaggttcggttacggtaacccctaactaacgtaacccttaaaccgaaacccgtaaacgggtaacccgtttacccgggtaacgggtaaaaacccgggggtccccgttaaacgtttaccccgaaacccgtaacttacccgttaaccggaaaaggtaaaaccgtaacccgttaaaacgtttaccccggaaaagggttaaacccctaaacttacgttttaagttaaacccttaccttttaaaacgaaaacgtttaacgggggtaaaaacttttaaaccccggagggttaaaaccgggaaccgggtaaccccgggaaacggtaacccggtaaaccccggggtccttaaagggtttacgttaaaaccggttttcggtaaccgggttaagggggttccggggttaaccctttaagggtttttaccccgtaccccgggggttaacccccggggttacgggggggttacccccggggtaaccctttcgggggtccccttaaaccccgggttcccccttaacccccccggtaaccccttaacccggtaaacccccgggg

SEQ ID NO: 416213 - DNA, 727 bp, Homo sapiens
  misc_feature: GZ8MTXP01E2806.22.85.H08.1.454.CMB.2.raw
  modified_base (379)..(379): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtcgggtcccgccgaggccgtaccggagggggaacggggcccgtagggaggtggattcctcgtactttatttagtaggtggtacggtaccanaatactacaacagctcgtagaacgggccgtattccacctatacctacaagaaacgaactaaacttaccgaacggaaactaactaagttattaacttacttaacaaaattacggggtaaacttaaacccgtaggaaacgaacgggaacccggaacgggaaccgaaccgggtaccctaagttaggttaaacgtttaacggtgggtttagggttacgggggtactttaacgttttaaccgttaccgggttacccccgggttcggggggttaccccggggtaaaccccgtcggggttaaccctaccccggtcccttaccccccgtaacccccgttaacccgaaacccccggg

SEQ ID NO: 416214 - DNA, 664 bp, Homo sapiens
  misc_feature: GZ8MTXP01AY7M4.22.85.H08.1.454.CMB.2.raw
  modified_base (296)..(296): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctctgtgcagtctcgtgggttcgtcgagtggcgactacatgagcgtgggtccncgacggcctaccggagggggaacgggtccgtagggaggtggacttcgtactactttatttagtaggtggtacggtaccatacgtactacaaacgacgaaccgtccggtaggaacggggcctactttccaacctatacctaccgaagaaacgaactaaacttaccgaaggaaactaactatttagttaacttacttaactaaagtaacgggtaaacttaacccgtagaacggaccgaccggaacgacgacggacctatacgtatacgtgtggttgggtacttacgttacgtcggacccggttcgggggacccggtaacccgtgggtccctacccgtcccttacccccgtcccgttaaccccgaacccgg

SEQ ID NO: 416215 - DNA, 670 bp, Homo sapiens
  misc_feature: GZ8MTXP01EJ9A0.22.85.H08.1.454.CMB.2.raw
  modified_base (293)..(293): a, c, t, g, unknown or other
  modified_base (354)..(354): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagctctcctgtgcagtctgtgggttcgtcaggtggcgactacatgagcgtgggtccncgaggctccgaggggacggcgtaggagtggactctctactttattatagtggtcgtaccanatacacaacagctccgtggaaacggctatcacattcagaaagtaagactaaattcccgaaaggtaaactactaagtttgtaacttacttaaacgaaaacttggggtaaaactttaacccgaggaaacggacgaccccgggaagtaaccgaaaccgggttcctaaagtttgttaaaccttacggtggttgggttacggggtctttaaacgtttccggtaccgggacccccggttggggggacccccggggtaaacccttcggggtaaccctacccccggtccccgaacccccctcccgttaaccccgaaaccccggg

SEQ ID NO: 416216 - DNA, 688 bp, Homo sapiens
  misc_feature: GZ8MTXP01AVIE5.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggacttaccatggagttttggctgagctgggttttccttgttgctatttcaaaaggtgtccagtgtgaggtgcagttggtggagacgtggaggaggcttgatccgaggccgtcgggggtcctgagactctcctgtgctagtcttgtcgggttcgtcgaggtggcgactacagtgagcgtcgggtccgccgacggcctccggaggggaacggggccgtggaacggtggtactctctactttatttagtaggtggtacgtaccccatatacctacacaagaccgtcggtaggaacgggccgtattccacgtatactacgagaaacgactaacgttacccgaaaggtaacacttaattgtaacttcgttaaacaaagttagaaacgttacgtaggaagaccggaccggaaggacccgaggacccttaagtgttacgtttaaccgtgggttaacgggtacgggttacgttacgttttaaccggttccgggaaccccggttcggggggaccccggttaaccgttcggaccctaacccggtcccctacccgttacccctccgaacccggtaacccgg

SEQ ID NO: 416217 - DNA, 814 bp, Homo sapiens
  misc_feature: GZ8MTXP01AN3FV.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtggaggaggcttgatccgaggccgtgggggtccctgagactctcctgtgcagttctcgtgggttcgtcgagtggcgactacagtgacggtcgtcgggtcccgccgaagggtccgtaccggaagggggaacgggtcccgtaggggtacgggtgggtactttccgttacgttaacgttttaagttttaagttacgggttcgggtttacccggtaaacccactaaacttaaccgtaaccgtaaaaccgaacgtaacccgtaccgggtagggtaaacggggcccgtaacttaccaacctaacttaccgtaacgaaaggaaaacgtaactaaacgttacccgaaaggtaaacctacttaatttaggttaacttaactttaaacgaaaacttacggggtaaaactttaacccgaggaacggtaacggacccggaaggtaccgaaccgggcttaagttacgttaaattcgggttgtcgggttacggggtactttaacgttttacccggtaccggggacccccggggtttcggggggaccccggggtaaccccgttggggtaaccccttaccccgggtccccttaaacccccgtcccgttaaccccgaaacccggg

SEQ ID NO: 416218 - DNA, 728 bp, Homo sapiens
  misc_feature: GZ8MTXP01BONPU.22.85.H08.1.454.CMB.2.raw
  modified_base (298)..(298): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgtactacatgagcgtcgggtccnccgaggcctccgaggggacggccgtggagtgacttctacgtactttattagtagtggtacgtaccatatacctacaacacgaacgtccgtagaacgggcctattccaaactatcctacaagtaaacgactaaacgttacccgaaagggtaactactagttacgtaacttactttaacaaaagttcggggtaaaacttaaccggttaggaaacggaaccggcccggaaacggtaccgaaaaccggggtcctaaaggttacgttaagtttaaccggtgggtttaaggggttcggggtaacctttaacggttttaaacccggttcccgggaaccccccggggttggggggacccccggggttaaacccctgggggtaacccctaccccgggttccccttacccccggtaaccccttaacccgaaacccccggg

SEQ ID NO: 416219 - DNA, 754 bp, Homo sapiens
  misc_feature: GZ8MTXP01D1418.22.85.H08.1.454.CMB.2.raw
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgacgactctcctgtgctagtctcgtgggttcgtcaggtggcgactacagtgagcgtcggggtcccgaccgacgggccgtaccggaagggggaacgggggtcccgtaggggaggttgggacttccttctaacttttaatttagtaggttcgggttacggtaaccactaactaacctaacaacaacgtaaccgtcgtagggaacggggcctaattaccgactatctagaagaaacgactaacttacccgaaaggtaacctaactatttacgttaacttacttaaactaaatacggtaaaacttaaaccgtaggaaacggacgaccggaacggaaccgaccggacctagtacggtttaacttacgtggttacgggttgggggttacttaacggttttaccgttacccgggttacccccggggttcggggggttaccccgggggtaacccggtaccgggttccccgtaccccgggttccccttacccccccgtaaccccgttaacccgtaaacccccggg

SEQ ID NO: 416220 - DNA, 662 bp, Homo sapiens
  misc_feature: GZ8MTXP01ELI5S.22.85.H08.1.454.CMB.2.raw
  modified_base (278)..(278): a, c, t, g, unknown or other
  modified_base (292)..(292): a, c, t, g, unknown or other
  modified_base (337)..(337): a, c, t, g, unknown or other
  modified_base (419)..(419): a, c, t, g, unknown or other
tcagacatacgcgtcacgaccggtgctcgatttagtatcactcagtcgcgggaggacgctgaccacacggtacgtgctgttgtactgctcctcccgcggctttgtcttggcattatgcacctccacgccgtccgcgtgccagttgaacttgacctcgagggtcttcgtggctcacgtccaccaccacgcatgtgaccgtcgaggggtccgggagatcatgagggtgttcgttggggtttgggggagaggagcccagcgagtgggtacttcggaggttnttccgtagttcggngatcagcactgaacacgagacggacctcacagtggtagtttcggntgtagtcgtttggtttcttgtgtactttacttacgtaaaaggtgtaccgaggtagttagtgggtacgtgttagggtttgggnggtaaggtagggtaggggagggtaggtcgttggaacgtcccggacggtccggggttccgggggttacctggaacggtccttcgttcgtgacggtcgtgttccgttaccggttggtaccgttgacggttacggacgtaaccgtagtagtcggaacggtcggttccgggccgacggtcggcggacccggaggggacgggtccgtaaggtcggtaggtacgttactaaccgtttaagttttaaggg

SEQ ID NO: 416221 - DNA, 855 bp, Homo sapiens
  misc_feature: GZ8MTXP01BNR9F.22.85.H08.1.454.CMB.2.raw
tcagacatacgcgtcacgaccggtgctcgatttagtatcactcagtcgcgggggggagaggagcccagcactgggattccgaggtgttcccattcggtgatcagcactgaacacagaggactcaccatggtagttttggctgagtcgttgggttttccttgttgcttatttacaaaaggtgtccagtgtgaggtgctaggttggtggagacgtgggaggaggtcttgactccgaggtcccggttcggggggtcccctggacgtaccttcgttcccgtggtcgcgtacgttccgttcggttcggggttcgtcgaggttgggaccgtactaacgagtggacggtccgtcggggtccccgacccgacgggccgtaccggaagggggaacggggccgtagggacggtggtacttccttacgttaacttttagtttaagtaggttggttaccggtaccctaactaattaacctaaccaaacgtacggtaaccgttcccgggtaagggaaaccggggtcccgtactttacccaaacctacttacctacgaaacggaaacgtaaacctaaaccgtttacccgaaaacggtaaacctaacttaagtttaacgttaactttaacccttaaagtaaaaacttacggggtaaaaactttaaacccgtaaggaacggaacggacccggaacgaacccgaacgggacctaagttacgttaagtttccgtgggttacggttcgggggtactttaacgtttaccggttaccgggttaccccgggttcgggggaccccggggtaaccccgttcggtcccgtaaccccggtccccttacccccgtaaccccgttaacccgtaaacccccggg

SEQ ID NO: 416222 - DNA, 651 bp, Homo sapiens
  misc_feature: GZ8MTXP01AOLQH.22.85.H08.1.454.CMB.2.raw
  modified_base (373)..(373): a, c, t, g, unknown or other
  modified_base (469)..(469): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccgagccgtgggggtccctgagctctcctgtgcagtctcgtgggttcgtcaggtggcgactacagtgagtcgtcgggtccgccgaggccgtacccgagggggaacgggccgtgggaggtggactcttcacgtttattagtagtggtcgtaaccanatactacaacagtcgtccgtaggtaacgggccgacttcacattacacgaagtaagacaaattcccgaaggaacactaattacgtatacctataaanagggtaaactaaaccgtggaaacgacggaccgaagaaccgacggacctaggtatacgttaagtggtggttcggggacttagttaccgttacgggaccccggttcgggggaccccggggtaaacctccgggtcccgtaaccccggtcccttaccccccgtaacccgttcccgaaacccccggg

SEQ ID NO: 416223 - DNA, 655 bp, Homo sapiens
  misc_feature: GZ8MTXP01DVMEA.22.85.H08.1.454.CMB.2.raw
  modified_base (282)..(282): a, c, t, g, unknown or other
  modified_base (616)..(616): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccggtgggggtccctgagctctctgtgcagtctcgtgggtcgtcaggtgcgactacntggagcgtggtcccgcgagcgtacgaggggacggctggagtgatctctactttattatagtggtacgtaccagtatacctaacaacgagtaaccgtccggtaaggaacgggtaccgtacttaccgaacctactctaacgaagtaaacgactaaacttaccgaaagtactaactatttagtactaacttaaacgtaaatacggtaaaacttaaccggagaaacggacgaaccccggaagaccgacgtacctaagttagtacctaaggttggtacgggttgggactttagtttaccgtcggacccgggttcggggaccccggtaacgtcggtcccnccccggtcccttaccccgtaaccccttaaccgaacccgg

SEQ ID NO: 416224 - DNA, 884 bp, Homo sapiens
  misc_feature: GZ8MTXP01EOFYS.22.85.H08.1.454.CMB.2.raw
tcagacatacgcgtcacgaccggtgctcgatttagtatcactcagtcggcggggggggagaggagcccagcactgggattccgaggtgtttccattcggtgatcagcactgaacacagaggactcaccatggtagttttggctgagtcgttgggtttttccttgttgcttatttacaaaaggtgtccagtgtgaggtgctaggttggtggagacgtgggaggaggtcttgactccgacggtccggtcggggggtccctggacgtaccttctccgtgtgcgtacgttcgtcggttcgggttcgtcgaggtcggaccgtactacgagttcggacggtccggtcgggggtccccgccgacgggtccgtacccggaaggggggaacgggtccggtaggggtacggttaggactttccttacgtttaacgtttttaagtttaggtagggttacgggttacccggttaaaccctaacgtaaactaaccctaccaaaccgtaacggtaacccgttccgggtaaacgggaaaccggggtaccctaactttacccaaacgtacttacccgtaaacgaaacggtaaacgtaacctaaacgtttaccgaaacggaaacctacgttaagtttacttaacttaacttaaactaaaattacggggtaaaactttaacgaggaacggacgaccggaacggaaccggtaaccgtacgtaagttaggttaacgttcggttgggttcgggttacgggggttaccctttaacggttttacccgggttacccggggttaacccccggggtttcggggggacccccgggtttaacccgttccgggtaaccccgtaccccggttcccccttacccccctaacccggttaacccccgtaaccccggg

SEQ ID NO: 416225 - DNA, 793 bp, Homo sapiens
  misc_feature: GZ8MTXP01C50QY.22.85.H08.1.454.CMB.2.raw
  modified_base (341)..(341): a, c, t, g, unknown or other
  modified_base (391)..(391): a, c, t, g, unknown or other
tcagacatacgcgtcacgaccggtgctcgatttagtatcactcagtcgcggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgaggccgtggggggtccctgagactctcctgtgcagtctcgttgggttcgtcgaggtggcgactacagtgagtcgtcgggtccgccgaggtccgtaccgagggggaacggtccgtaggngtggtacttctacgttactttatttaagtggttcgggtaccgtacctaanactaaccgtaacaaaccgtaacgtaacccgttacgggtacgggtaaacggggtccccgtaacttcccgaaacctattccctaacgaaacggtaaacgaacctaaacttacccggaaaggtaacctaacttaagtttacgtaacttacccgttaaataaaacgttaacggggtaaaacttaaacccggtaaggtaaacgggaaccggtaaccccgggaaacggaccgaaacccgggtcccttaaaggttagttaacgtttacggttaagggttcggttacgggggtaccttaagttttacccggtaccggttaccccgggttcgggggaccccgggttaaccgtccgggtaaccccgtacccgtccccgttaccccccgtaaccccgttcccgtaaccccggg

SEQ ID NO: 416226 - DNA, 890 bp, Homo sapiens
  misc_feature: GZ8MTXP01CL8M2.22.85.H08.1.454.CMB.2.raw
  modified_base (299)..(299): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcgttgggttttccttgttgctatttcaaaaggtgtccagtgtgaggtgcagttggtggagacgtggaggaggcttgatccgagccgtgggggtcctgagactctcctgtgcagtctcgtgggttcgtcagtggcgactacatgagcgtcgggtccnccgaggctccgaggggacggcctggacgtggattcgtactactttatttagtagtcggtcggtaccatatactacaacagtcctcgtaggaaacggggcctattccaactacgtctaccaaagaaacgtacaaacttacccgaaaggtaaaccctactaagtttagttaacttaccctttaaaaacgtaaaacgttaacggggtaaaaccgtttaaaccggtaacgggaaaccgggtaaacccgggtaaaccccggggtaaacgggttaaaccccggtaaaccccggggttaaaccgttaaaacggttttaaccggttttaaaccgttttaaccggggtttaacgggggtttaacgggggttaccgggggttaaaccttttaaaccgggttttttaaaccccggggttaccccgggggttaaacccccccggggggtttaccgggggggggttaaaaccccccccggggggtttaaacccccgtttaccccgggggttaacccccccgttaaccccccggggtttaaccccccccgttaacccccccccgtaaaacccccccggttaacccccgggtaaaaacccccgggg

SEQ ID NO: 416227 - DNA, 690 bp, Homo sapiens
  misc_feature: GZ8MTXP01D4YNL.22.85.H08.1.454.CMB.2.raw
  modified_base (360)..(360): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgcgaggctccgaggggaagggcctggagtggattctctactttatttataggtggtcggtaccanatactacaaacagctcgtaggaaacgggccgtattcacatctacaagaagacaattccaaaggaacactattataactacttaacaaattagggtaaactaaacccgtggaacgaacggacccgaaagggaccaaccgggtcctaagttacggttaatttcggtaaggttggggttacgggggtaactttaacgttttacccggtttcccgggaacccccggggttcggggggggttaaccccccggggtaaaccccgttcgggtaaccccgtaccccgggttaccccttacccccccggtaaccccttaacccccgtaaaacccccggg

SEQ ID NO: 416228 - DNA, 673 bp, Homo sapiens
  misc_feature: GZ8MTXP01D2X5X.22.85.H08.1.454.CMB.2.raw
  modified_base (310)..(310): a, c, t, g, unknown or other
  modified_base (317)..(317): a, c, t, g, unknown or other
  modified_base (355)..(355): a, c, t, g, unknown or other
  modified_base (416)..(416): a, c, t, g, unknown or other
tcagacatacgcgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccggagatcagtggagggttgttccgttggggtttgggggagaggacgcccagcacgtgggacttccggaggttcgtttcctagttcggtgatcagcatgaacanagagacncacagtggtagtttgctgagtcgttggtttcttgttgnttattacgaaaggtgtcgtagtgtagagtgcgtagggttggtagaggtacgtaggggaggngtgttgacgtccgacggtccgggttcgggggtacccttggacgtaccgttcgtcgtgtcgtcgtacgtttcgttccggttcgggtttacgtccggtaggtcggtaaccgtaccgttaagacgttacggcggtccggttcccggggttcccggtaccggttacgggtacccgtaaccccggggaagggggttacgggttcccggtaaggggtaacggtcgggtattccgttacgttaacgtttttaagttttaacggg

SEQ ID NO: 416229 - DNA, 571 bp, Homo sapiens
  misc_feature: GZ8MTXP01D0M0Y.22.85.H08.1.454.CMB.2.raw
  modified_base (282)..(282): a, c, t, g, unknown or other
  modified_base (296)..(296): a, c, t, g, unknown or other
  modified_base (317)..(317): a, c, t, g, unknown or other
  modified_base (319)..(319): a, c, t, g, unknown or other
  modified_base (352)..(352): a, c, t, g, unknown or other
  modified_base (362)..(362): a, c, t, g, unknown or other
  modified_base (364)..(364): a, c, t, g, unknown or other
  modified_base (384)..(385): a, c, t, g, unknown or other
  modified_base (389)..(389): a, c, t, g, unknown or other
  modified_base (393)..(393): a, c, t, g, unknown or other
  modified_base (395)..(395): a, c, t, g, unknown or other
  modified_base (411)..(411): a, c, t, g, unknown or other
  modified_base (418)..(418): a, c, t, g, unknown or other
  modified_base (434)..(434): a, c, t, g, unknown or other
  modified_base (533)..(533): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttggatccagccgtgggggtccctgagactctcctgtgcagtctcgtgggttcgcaggtgcgacacngtgagcgtggtccncgaggctcgagggaggctggngnggtatctcgtatttattagtgtggtcgtaccanatactacaanancgctagaacgggctatcacnnctanagananaatcaagacactatanatctaanaaattaggaaataacngagagaccgagacacgctagtagttatcgtaagtggttgggacttagttaacgtccggttaacccggttcgggggaccccgggtaacccgtcggtaacnccccggtaccccttacccctaacccgccgaaaccccgg

SEQ ID NO: 416230 - DNA, 712 bp, Homo sapiens
  misc_feature: GZ8MTXP01EEJ1W.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgcagtggcgactacatgagcgtgggtccgcgaggcctaccgaggggaacgggcctggacgtggacttctctactttatttataggtggttacggtaacccagaattaacctacaaaccagaaccgttaccggtaggaaacgggcccgtattccgaaccctatacctacaacggaaacgtaactaaactttacccgaaaggaaacctactaacttcgttaacttacttaaacaaattaacgggtaaacttaaacccgtaggaacggtacggaccggaacggaccgaacgggacctaagttagttaacttcggtaaggttcggttgggggtacttaacgttttaccgttaccggttaccccgggttcgggggaaccccggggtaacccggtacggtcccgtacccggttcccaccccccgtaaccccgttaaccccgaaccccggg

SEQ ID NO: 416231 - DNA, 610 bp, Homo sapiens
  misc_feature: GZ8MTXP01A62NC.22.85.H08.1.454.CMB.2.raw
  modified_base (364)..(364): a, c, t, g, unknown or other
  modified_base (405)..(405): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccgagggggaacgggccgtgggaggtggatctcactttatttataggtggtcgtaccanatactacaacagctcgtagacgggccatcacatctcagaanacaattccaaggacactattagtactacttacaaatggaaactaaccgtagacgaaggccggaacggacgaccgggaccctagtagtaacttacgtggtggttgggggcttagtttaccgttcggaccccggttcgggggacccgggaacccgttcgggtaaccgtacccggtccccttccccgtaaccccgttccgaaccccgg

SEQ ID NO: 416232 - DNA, 634 bp, Homo sapiens
  misc_feature: GZ8MTXP01EBFEA.22.85.H08.1.454.CMB.2.raw
  modified_base (298)..(298): a, c, t, g, unknown or other
  modified_base (471)..(471): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagttctcgtggggttcgtcgagtggcgactacatgagctgggtccncgaggctcgaggggacggcctggagtggatctctactttatttagtagtggtacgtaaccagtatactacaacagccgtcgtaggaacggggcctattccaactattctaccgaagaaacgaacctaaacgttacccgaaaggaaactactaatttagtaacttaccttaaanaaaagttgggaaaacttaaccgtagaacgacgaccggaaggaccacggctaagttcgtatcgtgtggttgggacttagtttacgtccgacccggttgggggaccccgggtaacctgggtcctccccggtcccttacccccgtaacccgttccgaaaccccggg

SEQ ID NO: 416233 - DNA, 769 bp, Homo sapiens
  misc_feature: GZ8MTXP01AYU0P.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatcgaaggccgtggggggtccctgacgtactctcctgtgctagtctcgtggggttcgtcgaggtggcgactacatggacgcgtcgggtcccgccgaggccgtccggaggggaacgggccgtgggaggtggactctactactttagtttagtaggtcggtaccggtaaccagtaacttaactaccgaaacgtaacgtaaccgtacccgggtaggaaaccggggtcctaattcccacctaactctacgaacgaaacgtactaaacttaccgaaacgggtaaacctacgttaacgtttacgttaacttacttaactaaaagttacgggtaaacttaacccgtagaacgggaaccggaccggaaacggaccgtaaaccggtacctaagttaggtttaacttaacgtggttaggggttacggggtactttaacgggttttacccgttcccgggttacccccggggttccggggggttaccccggggttaacccggtccgggttaaccccgtaccccgggttccccttaccccccgtaaccccgcccgtaaaccccggg

SEQ ID NO: 416234 - DNA, 817 bp, Homo sapiens
  misc_feature: GZ8MTXP01AR0IU.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagacgtggaggaggtcttgactccgagccggtggggggtccctggacgtactctcctgtcgcagttctcgtgggttcgtcaggtcggacgactacagtgacgtcgtcgggtcccgccgaggccgtccggaagggggaacggggtccgtaggggagtcggtacttctaccgtaactttaagtttacgtaggttcgggttaccggtaacccaacgtaactaaccgtaaccaaaccgtaacgtaaccgttacccgggtagggaaaccggggtcccgtaactttacccaaaccctaactacccgttaacgaaaacggaaacgtaaaccttaaacgttacccgaaacgggaaacctaactaagttttaagttaaacctttacctttaaaacaaaacgttaacggggtaaaacttaaaacccggttaggaaacggtaacccggacccgggaaacggaacccgtaaaccgggtaccctaagttacgggtttaaaccttaggttgtgggttcggggtactttaacgtttacgtcccgggttaccccggttccgggggacccgggttaaccctcggtaacccgtacccgtccccgttacccctaaccccgttcccgaaccccgg

SEQ ID NO: 416235 - DNA, 910 bp, Homo sapiens
  misc_feature: GZ8MTXP01D2AW3.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcgttgggttttccttgttgcttatttacaaaagatgtccagtgtgaggtgcaggttggtggagacgtgggaggaggcttgatccgagccgtgggggtccctgagactctcctgtgctgtctcgtgggttcgtcgagtggacgactacagtgagcgtcgggtcccgccgacggccgtaccggagggggaacgggcccgtagggaggtcggtaacttccgttacttaacgtttaagtttagtacgggtttcggggtacggttaaaccaacgtaacttaaacctaaaacccgaacgtaacggtaaccgttacccgggtaagggtaaacccggggtaccccttaacgttccaaacccgactttaccgaaacgaaacggtaaacgtaaacctaaacgtttaaacccaaacgggtaaaacctaccgttaaagttacgttaaacttactttaaaccgtaaaagggtacggttaaaaacctaaccggttaagaaccggtaaacggaccccggtaagggaacccgtaacccggtaccgttaaacgtttcggtttaaacgtttaaccggttcgggtttaagggggttccgggggttaacgttttaaacccgttttcccggggttttaaccccgggggttaaccccccgggggtttacccgggggggggtaaacccccggggttaaacccccgggttttcccggggttaaccccggttaaccccccggttcccccgttaaccccccccccgttaaaccccccgttaaccccccgggg

SEQ ID NO: 416236 - DNA, 695 bp, Homo sapiens
  misc_feature: GZ8MTXP01B76ZP.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtcctgagactctcctgtgctagtctcgtgggttcgtcgaggtggacgactacagtggagtcgtcgggtcccgccgaggccgtaccggaagggggaacggggccgtgggagtggacttctactaactttagtttagtaggtggtacgtacctactagtaacctacaaacgacgtccgtccggtagaacgggccgtacttaccgacatcctacgaagaacgaactaacttaccgaaggaaacctactattagtacttacttaacaaagttacggaaacttaacgtagaacgacgaccgaaggacgaccggtacctaagttacgttaacgttcgtggtggttcggggtaacttacgttttaacccggtcggttacccccgggttcgggggaccccggggtaacccgtccgggtaacccgtaccccgtccccgttaccccctaaccccgttaacccgaaccccggg

SEQ ID NO: 416237 - DNA, 593 bp, Homo sapiens
  misc_feature: GZ8MTXP01AIINY.22.85.H08.1.454.CMB.2.raw
  modified_base (290)..(290): a, c, t, g, unknown or other
  modified_base (334)..(334): a, c, t, g, unknown or other
  modified_base (414)..(414): a, c, t, g, unknown or other
  modified_base (419)..(419): a, c, t, g, unknown or other
  modified_base (433)..(433): a, c, t, g, unknown or other
tcagacatacgcgtcacgaccggtgctcgatttagtatcactcagtcggcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagcctgggggtccctgagactctcctgtgcagtctctgggttcgtcagtggcgactcatgagctgggtccncaggctccgaggggaaggcctggagtggatcgtcactttattanagtggtcggaccacatactacaacagaactccggtagaaggggccattcaccatctcagtaagacaattcaaggaaccanagttntaactcctttaaanaaatacggaaactaacgtgaacggacgccgaggtacgacggctagtcgtattcgtggtggttgggtcttacgtttaccgtacggaccccgggttcgggggcccgggtaacccgtcggtaacccgtacccgtcccttccccgtaacccgttcccgaacccg

SEQ ID NO: 416238 - DNA, 428 bp, Homo sapiens
  misc_feature: GZ8MTXP01EL3F0.22.85.H08.1.454.CMB.2.raw
  modified_base (402)..(402): a, c, t, g, unknown or other
  modified_base (420)..(428): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttactgaccccgtggggccgggaaccctggtcaccgtctcccaccctccaccaaggcccatcggtcttccccctggccaccctcctccaagcgccaccgtcgtgggggccacgacgcggacccgtggctgcctggtccaaggactactccacgcgtatgtctgagcgggntgggcaagggcacatagnnnnnnnnn

SEQ ID NO: 416239 - DNA, 736 bp, Homo sapiens
  misc_feature: GZ8MTXP01CS3H5.22.85.H08.1.454.CMB.2.raw
  modified_base (300)..(300): a, c, t, g, unknown or other
  modified_base (318)..(318): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagtcgttgggtttttccttgttgcttatttacaaaaggtgtccagtgtgaggtgctaggttggtggagacgtggaggaggtcttgactccgagccggtgggggtccctgacgctctctgtgctagtctcgtgggttcgtcgaggtcggacgactacgngtgacgtcgtcgggtccnccgaggccgtacggaggggacggccgtaggagtggtacttcgtacttacgtttatttagtaggttcggtaccgtaaccagtaacttaacctaacaaacgaacgtaaccgtaccggtaagggaaacgggtccctaatacccgtaacctactccgtaacgaaagaaacgaactaaaccgttaaccgaaagtaaactactagttagttaacttactaaataaagtaggtaaacttaaccgtagacggaacgaccgaaaggaccgtaaccggtactaagttacgttaagttcgttgggtcgggttacgggtactttacgttttaccggtcccgggaaccccggggttcgggggaccccgggttaaccccgtcggtccccgtaccccgttccccacccccgtaacccgttcccgtaacccggg

SEQ ID NO: 416240 - DNA, 664 bp, Homo sapiens
  misc_feature: GZ8MTXP01AYC75.22.85.H08.1.454.CMB.2.raw
  modified_base (279)..(279): a, c, t, g, unknown or other
  modified_base (292)..(292): a, c, t, g, unknown or other
  modified_base (316)..(316): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggagcttgatccagccgtgggggtcctgagactctcctgtgcagtctcgtgggttcgtcagtggcgactacntgagctgggtccncgaggctcgaggggaggccgtggngtggatctacgtactttagtttataggtcggtacggtaccacgtaatacctaactaaaccgaagaaccttccggtaggaaacgggtcccgtaatttaccgacctagtcctacaagaacgaactaaacttccgaaggaacactattagtattacttaacaaattagggaaactaaaccgtgaagacggaccgaaggaccgaccggccctaagttagtaactttaacgtggttacgggttcgggggtacttaggttttaccgtacggttaccccggttcgggggaccccgggtaaacccggtcggtcccgacccggttcccttacccccgtcccgttccccgaacccggg

SEQ ID NO: 416241 - DNA, 740 bp, Homo sapiens
  misc_feature: GZ8MTXP01EIAWI.22.85.H08.1.454.CMB.2.raw
  modified_base (299)..(299): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtcctgagctctctgtgctagtctcgttggttcgtcaggtggcgactacagtgagcgtgggtcccncgaggcctaccgagggggaacggcctggagtggacttctcgtaacttttagtttagtaggtcggttacgtacccataagtaccctacaaacgagtaaccgtccggtaggtaacggggccctagttaccaaccgtatacctacaaggaaacgtacaactttaccgaaaggtaaactactaagttagtaacttacttaactaaacttaggaaaacttaacccgtaggaaacggaaccggaccggtaaggtaaccgaaccgggtaccctaaagttacgttaaacgtttaaaccggtgggttacgggttacgggggttactttaacggtttacccgttaacccgggacccccggggttacgggggttaccccgggtaaacccgttcgggtaacccgttaccccggtcccgttacccccctaaccccgttccgtaaacccccgggg

SEQ ID NO: 416242 - DNA, 684 bp, Homo sapiens
  misc_feature: GZ8MTXP01ECTWN.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgagtggcgactacagtgagcgtggtccgcgaggctccgaggggaacggccgtaggagtggacttcgtactactttatttagtagtcggtacgtacacgatactacaacagctcgtagacgggcgtattcacagtctacgaagaacgaactaacttaccgaaacggaactaactatttacgtaattacccttaaataaacgttacgggtaaacttaaacccgttagaaacggaaccggaccggaacggacgaacccgggtacctaagttagttaaccttagttggtcgggttagggggtacttaacgttttaccgttaccgggttaccccgggttcgggggttaccccgggtaacccgtcgggtaacccgtaccccggttcccaccccgtaacccccgttccgtaaacccccggg

SEQ ID NO: 416243 - DNA, 715 bp, Homo sapiens
  misc_feature: GZ8MTXP01A7MES.22.85.H08.1.454.CMB.2.raw
tcagacatacgcgtcacgaccggtgctcgatttagtatcactcagtcggcggggggggagaggagcccagcactgggattccgaggtgtttccattcggtgatcagcactgaacacagaggactcaccatggtagttttggctgagtcgttgggtttttccttgttgcttatttacaaaaggtgtccagtgtgaggtgcgtagttggtggagacgtgggaggaggtcttgactccgacggtccggttcggggggtccctaggacgtaccttcgtccgtggtcgacgtacgttccgttcggttcggggtttcgtacgtaggttcggaccgtaacttacgagtggacggtcggtccgggtcccgacgacggccgtaccgggaagggggacggtccgtagggagtcggtacttctacgttatttagttagtaggtggtaccgtaaccaactataactaaccaaacacgtaaccgttcggaaggaccgggcctactacactatctacgaaagtaacactaacttacgaaagtaactattaagtttatacttaacgtaataaacgttagaaacttaaggcgaacgacgaccggacggtacgaccggtatagtagttatacgtggttaggttcggtactttacgtcgttccgggacccgggttcggggaccgtaacccgtgtccgtaccccgtcccttaccccgcccttaaccgaacccgg

SEQ ID NO: 416244 - DNA, 470 bp, Homo sapiens
  misc_feature: GZ8MTXP01CIYM0.22.85.H08.1.454.CMB.2.raw
  modified_base (334)..(334): a, c, t, g, unknown or other
  modified_base (452)..(470): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggctatttactcgaccccgtgggggccgggaacctggtccaccgtcctcccccacccctccaccaacgggccccagtccggtccttccccccgtggcccacccctccnccaagcgccacctcgcgggggccacgacgccggcccgtggctcgcctggtacccacggtactaccgttccacggtcgtatcggtctgggacggcggggctgggacacgggcgcagtgnnnnnnnnnnnnnnnnnnn

SEQ ID NO: 416245 - DNA, 798 bp, Homo sapiens
  misc_feature: GZ8MTXP01C62U1.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctccgtgtgctagttctcgttgggttctcgaggtggcgactacatgagcgtcgggtccgccaggcctccgaagggggaacgggccgtgggacgtggacttcgtctatttactttagtaggttcggttaccggtacctaacgtataacctaccaaacgtaacgtaaccgttccggtacgggaaacggggtcccgtaactttaccgaaccctattaccccttaagaaacggtaaaacggtaacctaaaactttaccccggaaaagggtaaacctaaaccttaagttttacggttaaacttacctttaaactaaaacgttaggggtaaaaccttaaacccgtagaacggaacggacccggaacgggaccaaaccggggtcctaaagttcggttaactttaccggttaaggttgggttacgggggtaaccttacgtttttaaccggtcccggttaacccccggggttcggggggacccccgggttaaaccccgttcgggtaaccccgtaacccggtcccccgttacccccgtaaccccgttaacccgaaacccccggg

SEQ ID NO: 416246 - DNA, 645 bp, Homo sapiens
  misc_feature: GZ8MTXP01DR4HV.22.85.H08.1.454.CMB.2.raw
tcagacatacgcgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcgaggggtccggagatcatggagggtgttccgttggggtttgggggagaggacgcccgagcacgtggggtacttccggaggttgttccagttcggtgatcagcactagaacacagagactcactagtggtagtttgctgagtcgttggttttccttgttgcttagttaccgaaaggttgtacgtgtggtagaggtgcgtagggttgggaggaggtacggtaggggagggtaggtacgttaggtacgtacccggacgggtccggggttacggggggttccccgtaggtacgtaccgttccgtccgtggtacgtcggtcggtttcgttccggttcgggttcgtcgtacggtggaccgtactcgtagtgaggtcgtcgggttccgcgaacggtccgtcggaggggcggccgtgggtacgtcggtattccgttattaacgtttaagttaagg

SEQ ID NO: 416247 - DNA, 640 bp, Homo sapiens
  misc_feature: GZ8MTXP01DJFFQ.22.85.H08.1.454.CMB.2.raw
  modified_base (296)..(296): a, c, t, g, unknown or other
  modified_base (353)..(353): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagctgggtccncaggctccgagggaggcctggagtggatctcactttattagtagtggtcggtaccanataactacaaacagtcgtccgtagggaaacgggccacttcaccctatctacaagtaaagaactaacttacccgaaggaaaccaactattagtacttacttactaaaataggtaaactaaaccgttagaacgacgaccgaaggaccaacggccctaagttgtaacttacgttggtggttggggtacttacgtttacgttcggaccccgggttcgggggccccggggtaacccgtcgggtaacccgacccggttcccttacccccgtaaccccgttcccgaaaccccgg

SEQ ID NO: 416248 - DNA, 642 bp, Homo sapiens
  misc_feature: GZ8MTXP01B020I.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtcgggtccgccgaggcctaccggagggggaacgggccgtagggaggtggaactcgtactactttattataggtggtcggtaccatatactacaacagctcgtagaacgggccgacttcaccatctacaagaagactaaacttccgaaaggaactactattcgtaactacttaacaaagttcggaaattaacccgtgaacgacgccgaaggacaccggcctaatacgttaacttcgtggtggttcggggacttaacgtttacgtaccggaccccggttcgggggaccccgggtaacccgtcgggtaaccctaaccccggtcccttaccccccgtaaccttaaccccgaacccgg

SEQ ID NO: 416249 - DNA, 718 bp, Homo sapiens
  misc_feature: GZ8MTXP01CPBXL.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcgagtggcgactacatgagcgtgggtcccgccgaggcctacccgagggggaacgggcccgtaggggagttggggtaacttccgtacgtaactttaatttagtacggttcgggtacggtaaccccaactataacctacctaaaccaaggtaacccgtaccgggtaggaaacggggtccctaatttcaacccactcttaccaaaggtaaacgtaacaaatttacccgaaagggaaacctaaccgtatttacgttaacttaccttaataaaacttggaaaacttaaccgtaggaagaaccgacccggaacggaaccgaacgggaccctaaggttagttaacgttacgtgggttaggttggggtcttacgtttaccgtcgttacccccggttgggggacccgggtaacccgtcggtcccacccggtcccttaccccgtaacccttcccgaacccgg

SEQ ID NO: 416250 - DNA, 701 bp, Homo sapiens
  misc_feature: GZ8MTXP01DXKW9.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtggaggaggcttgactccgagccgtgggggtccctgacgctctctgtgctagtctcgtggtcgtcgagtcggacgactacagtgagcgtcgggcgccgagcgtaccggaggggacggcgtaggagtggtactctacgtactttagttagtgtggtacgtaccactatactacaacacgtaacgtcggtaagacgggaccgtacttaccactaactctaacgaacgaaacgactaaacttacgaaaacggtacctattaatttacgtaactttacttaaactaaagttacgggtaaactaaaccgtggaacgacggaccgaacgggaaccacggtacaatttacggtaaatttccggtgttagggttgggttaccttaaagttttacccggtccgggttaaccccgggtttcggggggaacccccgggtaaccgtttggtaacccccgtaaccccggttccccttacccccgtaaccccgttccgaaaaccccgg

SEQ ID NO: 416251 - DNA, 468 bp, Homo sapiens
  misc_feature: GZ8MTXP01B2LBW.22.85.H08.1.454.CMB.2.raw
  modified_base (446)..(446): a, c, t, g, unknown or other
  modified_base (448)..(468): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtgggctatttactgacccgtggggccgggaaccctggtcacgtctcccaccctccacaggccatccggtctcccctgaccaccctcctccagacgcacctcgtgggggcacgacgcggccccgtggcctgccgtggtcccaaagggtacctaccgttcccacggtaccgttatcggtacctggacgggccggggcgtgggacgaaagggccggacagtaggngnnnnnnnnnnnnnnnnnnnnn

SEQ ID NO: 416252 - DNA, 568 bp, Homo sapiens
  misc_feature: GZ8MTXP02JLHPQ.22.85.H08.1.454.CMB.2.raw
  modified_base (338)..(338): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtcccgccaggctccgaggggaagggccctggagtggatctcacttatttanagtggtcggtaccacatactacacagctccgtgaaagggcccattcaccatctcaagaagacaaattcccaaggaaccactaattgtatctttacaaattgaaaataacctagaagagccgaggacacggccatgtaatacgtgtggtggggactagtttacttcggaccccgttgggggacccggggtaaccctgggtccacccggtcctcccccaccctcccaacccg

SEQ ID NO: 416253 - DNA, 569 bp, Homo sapiens
  misc_feature: GZ8MTXP02FZ6Q7.22.85.H08.1.454.CMB.2.raw
  modified_base (337)..(337): a, c, t, g, unknown or other
  modified_base (352)..(352): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactggaggaggcttgatccagccgtgggggtccctgagactctcctgtgcagtctcgtgggttcgtcagtggcgactacatgagctgggtccgccaggctccgagggaaggcctggagtggatctcactttatttanagtggtgtaccccanatactacacagactccgtgaaagggccgattcaccatctacagaagacaaattcccaaggaaacacattagtatacttacaaaattgaaataacctgagagaccgagacacggaccatgtaattacgtgtgtggggactagtttaacgtcgaccccgtcgggggcccgggtaacccgtggtccaaccggtccctcccccaccctcccaccgaaccgg

SEQ ID NO: 416254 - DNA, 643 bp, Homo sapiens
  misc_feature: GZ8MTXP02HT268.22.85.H08.1.454.CMB.2.raw
  modified_base (275)..(275): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcgtggtttcgtgtaggctattacaaaaggtgtcagtgtgaggtgcagttggtggagactggaggaggcttgatccagcctggggggtccctgagactctcctgtgcagtctctgggttcgtcagtgggcactanatgagcgtcgggccgcgacggcctccggaaggggaacgggtccgtggaggtaggtagtctactactttaatttaagtaggtaggtacggtacctaactactaactaacacaacgacgtacgtacggaacgggacgtactacaccactactacaagaaacgaaacaaactacaacgaaacaactaattacgttattacttaactaaataagtaaactaaactagagagacgaacggaacgacgacgagtagtattacgtacgtggtagggtacgtacgttacgttaccgtacccggtaccggggtacccggggtaacccggtaccggtaccgtacccgtacccgtaccccctaccccgtacccgacccg

SEQ ID NO: 416255 - DNA, 564 bp, Homo sapiens
  misc_feature: GZ8MTXP02H8L9R.22.85.H08.1.454.CMB.2.raw
  modified_base (466)..(466): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtcccgccaggctccgaggggaacgggcctggagtggatcgtcacttatttataggtggtggtaccacatactacacagacctccgtagaacgggccgattccaccatcctacagaagacaatccaaggaacacattgtatcttacaaatagaaataactgagagacgagacacggcangtatactgtggtgggctagttactacgaccccgttgggggacccggggtaacccgtcgggtacctacccggtcctcccccgaccctacccgaacccgg

SEQ ID NO: 416256 - DNA, 593 bp, Homo sapiens
  misc_feature: GZ8MTXP02F3OM1.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgtctatttcaaaaggtgtccagtgtgaggtgcagttggtggaggacgtggaggaggcttgagtccagccgtgggggtccctgagactctcctgtaaagcagtctctggttcgtcagtggcgactacatgagcgtggtcccgccaggctccgagggaagggccgtggaggtggatctcgtacttattatagtggtcgtaccacgatactacacagctcgtagaagggccgagttcacatctacagaacgacaattccaagaacactatcgtatcttacaaatagaaactaacctagaacgagaccgaaggaccacggaccatagtacttagtggtaggtaggggtactaagtttacgtacggaccccgtcgggggacccggggtaacccgtcggttaccgaccccgtccgtaccccgtaccccgtccgaaacccgg

SEQ ID NO: 416257 - DNA, 526 bp, Homo sapiens
  misc_feature: GZ8MTXP02G9CBP.22.85.H08.1.454.CMB.2.raw
  modified_base (347)..(347): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgcaggctccgaggggaggcctggagtggatctcacttatttatagtggtcggtaccanatactacacagactccgtgaagggccattcaccatctcagaagacaattcccaaggaacacattgtatcttacaaatgaaataacctgagagccgaggacacggcatgtatactgtgtgggctattactcgaccccgtggggacccggaactggtccacgtcctccccacctccaaccg

SEQ ID NO: 416258 - DNA, 527 bp, Homo sapiens
  misc_feature: GZ8MTXP02GI0KY.22.85.H08.1.454.CMB.2.raw
  modified_base (291)..(291): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccncaggctccagggaggcctggagtggatctcacttattatagtggtgtaccacatactacacagctccgtgaagggccgattcaccatctcagaagacaattccagaacacattgtatcttacaaatgaaataacctgagagccgaggacacggccatgtattactgtgtggggctatttactcgacccgtggggcccggggaacctggtccaccgtcctccccaccctccaacccg

SEQ ID NO: 416259 - DNA, 543 bp, Homo sapiens
  misc_feature: GZ8MTXP02JT052.22.85.H08.1.454.CMB.2.raw
  modified_base (349)..(349): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgaggggaaggcctggagtggatctcacttatttatagtggtcggtaccanatactacacagactccgtagaacgggccgattcaccatctcagaagacaattcccaggaacacattgtatcttacaaatgaaatacctgagagccgaggacacggcatgtattactgtgtggggctatttactcgaccccgtgggggacccgggaacctggtaccacccggtcctcccccgaccctccaacccg

SEQ ID NO: 416260 - DNA, 568 bp, Homo sapiens
  misc_feature: GZ8MTXP02FSBPE.22.85.H08.1.454.CMB.2.raw
  modified_base (417)..(417): a, c, t, g, unknown or other
  modified_base (424)..(424): a, c, t, g, unknown or other
  modified_base (429)..(429): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaaggcctggagtggatctcacttattatagtggtggtaccacatactacacagactccgtgaaagggccgattcaccatctcagaagacaaattcccaggaacacatttntatctanaaatnaataactagagagacgacgacgacgacatagtattatgtggtgggtacgtacttacgttacgtacccggtaccggggtaccggggtaaccggtaccggtaccgtacccgtacccgtacccctaccccgtacccgacccg

SEQ ID NO: 416261 - DNA, 516 bp, Homo sapiens
  misc_feature: GZ8MTXP02G36VL.22.85.H08.1.454.CMB.2.raw
  modified_base (292)..(292): a, c, t, g, unknown or other
  modified_base (385)..(385): a, c, t, g, unknown or other
  modified_base (393)..(393): a, c, t, g, unknown or other
  modified_base (406)..(406): a, c, t, g, unknown or other
  modified_base (419)..(419): a, c, t, g, unknown or other
  modified_base (428)..(428): a, c, t, g, unknown or other
  modified_base (447)..(447): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggccncaggctccgagggaggcctggagtggatctctactttattatagtggtcgtacacatactacacagactccgtagaagggccattcacatcanaagaatanatacagacacatntatatacaaatanaataactanagagacgagacgacgacanatatatgtgtggcgattactcgtaccgtcgggccgggaaccgcgtcgacgcctcccacccaccaacccg

SEQ ID NO: 416262 - DNA, 546 bp, Homo sapiens
  misc_feature: GZ8MTXP02IK1QU.22.85.H08.1.454.CMB.2.raw
  modified_base (311)..(311): a, c, t, g, unknown or other
  modified_base (334)..(334): a, c, t, g, unknown or other
  modified_base (349)..(349): a, c, t, g, unknown or other
  modified_base (456)..(456): a, c, t, g, unknown or other
  modified_base (530)..(530): a, c, t, g, unknown or other
tcagacatacgcgtcacgaccggtgctcgatttagtatcactcagtcgcgggggaggaggagcccagcactgggattccgaggtgtttccattcggtgatcagcactgaacaccagaggactcaccatggagttttggctgagctgggttttccttgttgctatttcaaaaggtgtccagtgtgaggtgcagttgtggagactggaggaggcttgatccagcctgggggtccctgagactctcctgtgcagtctctggttcgtcagtggcgactacatgagctggggtccgcaggctccgagggaaggccnggacgtggatctcacttatttanagtggtcggtaccanatactacacagactccgtagaacgggcccgattcaacccatctcaagaagacaaattcccaaggaacgaactattacgtatacttacaaaattgaaataacctaganagccaggacacggcatgtataactgtagtgggctagtttactcgacccgtggggccggaacctggccaccgtcnccccgacctcaacccg

SEQ ID NO: 416263 - DNA, 555 bp, Homo sapiens
  misc_feature: GZ8MTXP02JM9ZY.22.85.H08.1.454.CMB.2.raw
  modified_base (325)..(325): a, c, t, g, unknown or other
  modified_base (410)..(410): a, c, t, g, unknown or other
  modified_base (422)..(422): a, c, t, g, unknown or other
  modified_base (428)..(428): a, c, t, g, unknown or other
  modified_base (436)..(436): a, c, t, g, unknown or other
  modified_base (468)..(468): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaaggcctggagtggatctnacttatttatagtgtcggtaccacatactacacagactccgtgaacgggccattcacatctcagaagacaattcccaggaaccanattgatcttaanaaatanaactaacngagacgacgagacacgcatagtatatggtggngggtactagtttacgtaccgtaccccggtcgggggacccgggtaaccgtcggtaccacgttcgtacccctacccccgaccctacccg

SEQ ID NO: 416264 - DNA, 529 bp, Homo sapiens
  misc_feature: GZ8MTXP02IDBCC.22.85.H08.1.454.CMB.2.raw
  modified_base (291)..(291): a, c, t, g, unknown or other
  modified_base (360)..(360): a, c, t, g, unknown or other
  modified_base (387)..(387): a, c, t, g, unknown or other
  modified_base (392)..(392): a, c, t, g, unknown or other
  modified_base (414)..(414): a, c, t, g, unknown or other
  modified_base (418)..(418): a, c, t, g, unknown or other
  modified_base (434)..(434): a, c, t, g, unknown or other
  modified_base (457)..(457): a, c, t, g, unknown or other
  modified_base (465)..(465): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccnccgaggctccgaggggaaggcctgggagtggatctctacttattatagtggtcggtaccacatacctanacagactccgtgaagggccattcacanctcanaagacaattccagaacacagtntatnttacaaatgaaatacngagagccgaggacacggtcagtntatactgngtgggcatttactcgacccgtggggccggaaccgtggtccaccgtcctccccaccctcaacccg

SEQ ID NO: 416265 - DNA, 569 bp, Homo sapiens
  misc_feature: GZ8MTXP02H9YRI.22.85.H08.1.454.CMB.2.raw
  modified_base (393)..(393): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttctcagtggcgactacatgagctggggtcccgccaggctccgaggggaacgggcctggagtggatcgtcactttatttatagtggtcgtaccacatactacacagctccgtgaacggggccattcacatctnagaagacaatcagaacacattagtatcttacaaatgaaataacctagagagaccgaggacacggacatagtattacgtggttaggtgggggtctagtttacgttcgaccccgttcgggggacccggggtaacccgtcggtacctacccggtacctcccccgacctacccgaacccg

SEQ ID NO: 416266 - DNA, 585 bp, Homo sapiens
  misc_feature: GZ8MTXP02G5YLS.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctggttttcctgttgctatttcaaaggtgtcagtgtgaggtgcagttggtggagactggaggaggcttgatccagccgtgggggtccctgagactctcctgtgcagtctctgggttcgtcagtggcgactacatgagctgggtcccgcgaggcctccgaggggaacggcctggagtggatctctactttattatagtggtacggtaccatatactacacagactccgtaggaaaggggccattacaccatctcaagaacgacaattacccaggaacactattagtattacttaacaaattagaaaacttaaccgagaagaagacccgaaggaacaccgggtaccatagttattaacgtggtgtggggactagtttactcggaccccgtgggggaccgggaacccgtcggtaccaccggtcctacccccaccctaccaacccgg

SEQ ID NO: 416267 - DNA, 600 bp, Homo sapiens
  misc_feature: GZ8MTXP02FRLVW.22.85.H08.1.454.CMB.2.raw
  modified_base (296)..(296): a, c, t, g, unknown or other
  modified_base (356)..(356): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgatccagccgtgggggtccctgagactctcctgtgcagtctcgtgggttctcagtggcgactacatgagcgtgggtccnccaggctccgaggggacggcctggagtggatcgtctactttattatagtggtcgtaccanatactacacagctccgagaacgggccattcacatctcaagaagaactaattacccgaaggaaacactaattagtatcttacaaatagaaactaaccgtagagagcccgaaggaccgacgaccatagtaattactggtggtggggtacttaagtttacttccggtaacccccggtgggggaccccggggtaaacccgttcgggtaccctacccggtccctacccccaccccgtacccaaacccgg

SEQ ID NO: 416268 - DNA, 603 bp, Homo sapiens
  misc_feature: GZ8MTXP02IWN4M.22.85.H08.1.454.CMB.2.raw
  modified_base (458)..(458): a, c, t, g, unknown or other
  modified_base (466)..(466): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtcccgcaggctccgaggggaagggcctgggagtgggatcgtactactttatttagtggtggtaccgtaccatactactacacacgccgtcgtaaggacgggtcctacttaccaactactctacaaaggaacaaactaacttaccgaaacgaacaactattatactctaaanaaagttanaaacttacgagagacgacgagacgccgatagtatatacgtgtgggtcggattacgtttacgtccgtacccggtcgggggacccggtaaccgtcggtaccctaccgtcccctacccccgtacctacccgaaacccggg

SEQ ID NO: 416269 - DNA, 529 bp, Homo sapiens
  misc_feature: GZ8MTXP02F75LO.22.85.H08.1.454.CMB.2.raw
  modified_base (455)..(455): a, c, t, g, unknown or other
  modified_base (463)..(463): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaaggccctggagtggatctctacttattatagtggtgtaccacatactacacagactccgtgaaagggccgattcaccatctcagaagacaattccaaggacacattgatcttacaaatgaaatactgaagagccgaggacacggccangtattacngtgtgggcatttactcgaccctgggggcccggaaccgtggacaccgtctccccaccctcaacccgg

SEQ ID NO: 416270 - DNA, 572 bp, Homo sapiens
  misc_feature: GZ8MTXP02IRC2W.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaaggcctggagtggatctcacttatttatagtggtcgtaccacatactacacagctccgtgaacgggccgattcaccatctacaagaagacaattcccaaggaacacattgtatcttacaaatgaaataacctgacgagccgaggacacggccatacgtattacgtgtggtggggactagtttacgtcgaccccgtgggggaccccggggtaacccgtgggttacccacccggtccctaccccccgaccctacccaaaccccgg

SEQ ID NO: 416271 - DNA, 563 bp, Homo sapiens
  misc_feature: GZ8MTXP02F251S.22.85.H08.1.454.CMB.2.raw
  modified_base (322)..(322): a, c, t, g, unknown or other
  modified_base (332)..(332): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctctgggttctcagtggcgactacatgagctgggtccgcaggctccgagggaggcctggagtggatctntacttattanagtggtcgtaccacatactacacagcctccgtgaacggggccgattcaccatcctacaagaagacaaattccaaggaacactattgtatcttaacaaatagaaactaacctgaagagaccgaggacacggaccatacgtattacgtgtgtgggctagtttactcggacccgtgggggacccggggtaaccctggggtaccaccggtaccctccccacccctcaaaccccgg

SEQ ID NO: 416272 - DNA, 541 bp, Homo sapiens
  misc_feature: GZ8MTXP02IUBH6.22.85.H08.1.454.CMB.2.raw
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctggggtccgccaggctccaggggaagggcctggagtggatctcacttatttatagtggtggtaccacatactacacagctccgtgaagggccgattcaccatctcagaagacaattcccaggaacacattgatcttcaaatgaataacctgagagccgaggacacggaccatagtattactagtgtgggggctagtttactcgaccccgtggggaccggggaaccgtcggtcgaccgtcctccccgaccctccaacccg

SEQ ID NO: 416273 - DNA, 606 bp, Homo sapiens
  misc_feature: GZ8MTXP02IFD3Y.22.85.H08.1.454.CMB.2.raw
  modified_base (265)..(265): a, c, t, g, unknown or other
  modified_base (267)..(267): a, c, t, g, unknown or other
  modified_base (274)..(274): a, c, t, g, unknown or other
  modified_base (278)..(278): a, c, t, g, unknown or other
  modified_base (309)..(309): a, c, t, g, unknown or other
  modified_base (314)..(314): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtggtttcgtgtaggctattacaaaaggtgtccagtgtgaggtgcagttggtggagactggaggaggcttgatccagcctggggggtccctgagactctcctgtgcagtctctgggttcgtngngcgacanatgngcgtcggtccgcgcgcgcgaggaggcgtggnggtgntctctattattatagtggtcgtacactatactacacacgtcgtcgtacggacggacgtactacacactactacagaacgaactaactacgaacgaactaactattagttacttacttactaaactaagtaactaacgtagacgacgacgacgacgacgacgtagtagtagttacgttacgtaggttagggtacgttacgtttacgttaccggtacccgggtaccggggtaccggggtaacccggtaccggtaccgtacccgtcccgtaccccctaccccgtacccgtacccg

SEQ ID NO: 416274 - DNA, 569 bp, Homo sapiens
  misc_feature: GZ8MTXP02JHLF2.22.85.H08.1.454.CMB.2.raw
  modified_base (289)..(289): a, c, t, g, unknown or other
  modified_base (387)..(387): a, c, t, g, unknown or other
  modified_base (391)..(391): a, c, t, g, unknown or other
  modified_base (404)..(404): a, c, t, g, unknown or other
  modified_base (418)..(418): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcgtggtttccgtgtagctattcaaaggtgtcagtgtgaggtgcagttggtggagactggaggaggcttgatccagcctggggggtccctgagactctcctgtgcagtctctgggttcgtcagtggcgactacatgagctggtccgccnggcgtccgaggggaagggccgtggagtgggatctctacttatttatagtggtggttacaccatactacacagactcgtgaggccgattcacatctcanaganattcagacacatntatcttacaaatanaataacctagagagacgacggacacggaccatagtattaactcgtggtgggtcggtattaacgttcgtacccgttacggggtcccggggaaacccggtacggtaccgtacccggtacccgttccccgtacccccgtaccctaaacccccgg

SEQ ID NO: 416275 - DNA, 547 bp, Homo sapiens
  misc_feature: GZ8MTXP02IDASE.22.85.H08.1.454.CMB.2.raw
  modified_base (434)..(434): a, c, t, g, unknown or other
  modified_base (530)..(530): a, c, t, g, unknown or other
  modified_base (539)..(539): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtggtttcctgtgctattcaaaggtgtcagtgtgaggtgcagttggtggagactggaggaggcttgatccagcctggggggtccctgagactctcctgtgcagtctcgtgggttcgtcagtggcgactacatgagctggggtccgccaggctccgagggaagggcctgggagtggatctcactttatttataggtgtcggtaccacatactacacagactccgtagaaacggggcctattcacctatcctagagaaagacaacttcaaggaacacattgatcttacaaatnaaataacctgagacgaccgaggacacggccatagtattacgtgtaggtgggtctagtttactcgacccgtggggaccgggaacctcggcaccgtcncccctaccnccaacccg

SEQ ID NO: 416276 - DNA, 538 bp, Homo sapiens
  misc_feature: GZ8MTXP02GHW7U.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctctacttattatagtggtcggtaccacatactacacagctccgtagaacgggccattcaccatctcaagaagacaattcccaggaacacattgatcttacaaatgaatacctgagagccgagacacggccatgtattactgtggtgggctatttactcgacccgtggggaccggaaccgtggaccaccgtcctaccccgaccctaccaacccg

SEQ ID NO: 416277 - DNA, 530 bp, Homo sapiens
  misc_feature: GZ8MTXP02G7NI5.22.85.H08.1.454.CMB.2.raw
  modified_base (512)..(512): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttctcagtggcgactacatgagctgggtccgccaggctccgaggggaagggcctggagtggatctcacttatttatagtggtggtaccacatactacacagctccgtgaagggccgattcacatctcagaagacaattccagaacacatgtatcttacaaatagaataactgagagaccgagacacggcatgtatactgtgtggggctattacgtcgacccgtggggaccgggaaccgtcggtacaccgtcnccccgacctaccaacccg

SEQ ID NO: 416278 - DNA, 546 bp, Homo sapiens
  misc_feature: GZ8MTXP02IZQEA.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcagtggcgactacatgagcgtgggtccgcaggctccgaggggaaggcctggagtggatcgtctacttatttatagtggtcggtaccacatactacacagctccgtagaacgggccgattcacatctcagaacgacaattccaagacacattgatcttacaaatagaataacctgagagccgaggacacggcatgtatacgtgtggtgggctatttacgtcgaccccgtgggggacccgggtaacctggcctacccggtcctacccccgacctaccaacccgg

SEQ ID NO: 416279 - DNA, 534 bp, Homo sapiens
  misc_feature: GZ8MTXP02G4FYO.22.85.H08.1.454.CMB.2.raw
  modified_base (334)..(334): a, c, t, g, unknown or other
  modified_base (348)..(348): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctggttcgtcagtggcgactacatgagctgggtccgccaggctacgaggggaagggcctggagtggatctcacttatttanagtggtggtaccanatactacacagctccgtgaagggccattcaccatctcagagacaatccagaacacattgatctacaaatgaataacctgagagaccgaggacacggccatgtaattactgtgtggggctatttacttcgaccccgttgggggacccggggaacctaggtccaccgtcctccccaccctccaacccg

SEQ ID NO: 416280 - DNA, 423 bp, Homo sapiens
  misc_feature: GZ8MTXP02IVT7Z.22.85.H08.1.454.CMB.2.raw
  modified_base (416)..(423): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccgggaaccctggtcaccgtctccccaccctccaccaaggcccatctgtcctccccctggccacccctcctccaagcgccacctcgtggggcacagcggcccgtgggctgcctggtcaaggactacttccacgcgtatgtctgagcgggctgggcaaggcgcatagnnnnnnnn

SEQ ID NO: 416281 - DNA, 540 bp, Homo sapiens
  misc_feature: GZ8MTXP02IOBSL.22.85.H08.1.454.CMB.2.raw
  modified_base (351)..(351): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaaggcctggagtggatctcacttatttatagtggtcgtaccanatactacacagctccgtgacggccgattcacatctcagaagacaattccaagacacatgtatcttacaaatgaaataacctgagaacgcgaggacacggccatgtattacgtgtggtagggctagtttacttcgacccgtggggacccgggaacctgggtacccaccggtcctccccacctccaacccg

SEQ ID NO: 416282 - DNA, 553 bp, Homo sapiens
  misc_feature: GZ8MTXP02F4568.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctctacttattatagtggtcgtacacatactacacagctccgtagaagggccgattcatcatctacagaagacaattacccaggaaacactaattagtattactttacaaaattagaaattaacctaggaagacgccgaaggaccacggccatgtaattactggtgtgggctatttacgtcgacccgtggggaacccggaccgtggtccaccgtcacccccacctacccg

SEQ ID NO: 416283 - DNA, 564 bp, Homo sapiens
  misc_feature: GZ8MTXP02JS1MQ.22.85.H08.1.454.CMB.2.raw
  modified_base (329)..(329): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccgaggcctccgaggggaaggcctggagtggatctnacttattatagtggtcggtaccacatactacacagctccgtgaacgggccgattcgaccatctacagaacgacaatccagaacacattgtatcttacaaatgaataactagagagacgaaggaccacggaccagtagtattacgtgtggtggggctagtttacgtcgaccccggtcgggggacccgggaaccgtcggtaccacccggtcctacccccgaccctaccgaaccccgg

SEQ ID NO: 416284 - DNA, 544 bp, Homo sapiens
  misc_feature: GZ8MTXP02IA3W2.22.85.H08.1.454.CMB.2.raw
tcagacatacgcgtcacgaccggtgctcgatttagtatcactcagtcgcggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgagggaaggcctggagtggatctcactttatttatagtggtgtaccacatactacacagctccgtgaaagggccattcaccatctcagaagacaattcccaggaacacattgtatcttacgaaattgaaataacctgaagagccgaggacacggccaatgtattactgtggtggggcatttacttcgacccccgttggggcccggggaacctggtacaccggtctcccccgacctcccaacccg

SEQ ID NO: 416285 - DNA, 399 bp, Homo sapiens
  misc_feature: GZ8MTXP02FUQFJ.22.85.H08.1.454.CMB.2.raw
  modified_base (308)..(308): a, c, t, g, unknown or other
  modified_base (315)..(315): a, c, t, g, unknown or other
  modified_base (322)..(322): a, c, t, g, unknown or other
  modified_base (328)..(328): a, c, t, g, unknown or other
  modified_base (341)..(341): a, c, t, g, unknown or other
  modified_base (395)..(399): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggctatttacttgaccccgtggggccgggaaccctggtcaccgtctcccaccctcaccaggccatcgtctcccctgcaccnctccagngcactcnggggcncagcgccgtggcngcctggccagctactccacgctatgtctgagcgggctgggcaaggcgcgatagnnnnn

SEQ ID NO: 416286 - DNA, 543 bp, Homo sapiens
  misc_feature: GZ8MTXP02INWPX.22.85.H08.1.454.CMB.2.raw
  modified_base (353)..(353): a, c, t, g, unknown or other
  modified_base (392)..(392): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctggttcgtcagtggcgactacatgagctgggtcccgccaggctccgagggaaggggccctggagtggatctcacttatttatagtggtcggtaccanatactacacagctccgtgaacgggccgattcacatctanagaagacaattccaaggaacactattgatcttacaaatgaaataacctgagagccgaggacacggcatagtattactgtggtgggctatttactcgaccccgtggggacccgggaaccgtcggccaccgtcctccccgacctccaacccgg

SEQ ID NO: 416287 - DNA, 527 bp, Homo sapiens
  misc_feature: GZ8MTXP02HNCK5.22.85.H08.1.454.CMB.2.raw
  modified_base (291)..(291): a, c, t, g, unknown or other
  modified_base (322)..(322): a, c, t, g, unknown or other
  modified_base (332)..(332): a, c, t, g, unknown or other
  modified_base (346)..(346): a, c, t, g, unknown or other
  modified_base (355)..(355): a, c, t, g, unknown or other
  modified_base (407)..(407): a, c, t, g, unknown or other
  modified_base (424)..(424): a, c, t, g, unknown or other
  modified_base (434)..(434): a, c, t, g, unknown or other
  modified_base (464)..(464): a, c, t, g, unknown or other
  modified_base (477)..(477): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcagtggcgactacatgagctgggtccnccaggctccaggggaggctggagtggatctnacttatttanagtggtcgtaccanatactacanagactccgtagaaacggccgattcacatctcagaagacaattcccagaacanattgatcttacaaagtnaaacttaacngagagccgaggacacggtcatgtatactgngtggctatttacncgacccgtggggccggaacctggtaccaccgcctccccacctacaacccg

SEQ ID NO: 416288 - DNA, 534 bp, Homo sapiens
  misc_feature: GZ8MTXP02FZ2BW.22.85.H08.1.454.CMB.2.raw
  modified_base (412)..(412): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccaggggaagggcctggagtggatctcacttattatagtggtggtaccacatactacacagacctccgtgaaagggccgattcaccatctcagaagacaattccagaacacattntatcttacaaatgaataacctgagagccgaggacacggcatgtatactgtgtggggctatttactcgacccctggggcccggggaaccctggtccaccggtcctccccgaccctccaacccg

SEQ ID NO: 416289 - DNA, 525 bp, Homo sapiens
  misc_feature: GZ8MTXP02FYJE1.22.85.H08.1.454.CMB.2.raw
  modified_base (290)..(290): a, c, t, g, unknown or other
  modified_base (310)..(310): a, c, t, g, unknown or other
  modified_base (312)..(312): a, c, t, g, unknown or other
  modified_base (354)..(354): a, c, t, g, unknown or other
  modified_base (460)..(460): a, c, t, g, unknown or other
  modified_base (465)..(465): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcagtggcgactacatgagctgggccnccagctcaggaagggcctgngnggatctcacttattatagtggtcggtaccacatactacacanactccgtgaaggccgacttcaccatctcagagacaattccagaacacattgtatcttacaaatagataacctgagagccgaggacacggccatgtattactgtggngggtnacgtttatcgacccgtcggggcgggaacccttggctaccggtcctcccaccctcaacccg

SEQ ID NO: 416290 - DNA, 575 bp, Homo sapiens
  misc_feature: GZ8MTXP02GZGSS.22.85.H08.1.454.CMB.2.raw
  modified_base (371)..(371): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcaggcctccgaggggaacggcctggagtggatctctacttatttatgtggtcggtaccacatactacacagctcgngacggcatcacatctacagaagacaattcccgaagaacacattagatacttacaaatgaaactaacctgaagacgaccgaaggaccacggaccagtagtattactggtggtaggggctaagtttaccgtacgacccccggtgggggaccccggggtaacctcgggtacctacccggtccctcccccaccctacccaaaccccgg

SEQ ID NO: 416291 - DNA, 584 bp, Homo sapiens
  misc_feature: GZ8MTXP02H37TZ.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcactacatgagcgtggggtccccgcgaggcctccgaggggaacgggcctgggagtggatctcactttaatttataggtggtcgtaccaacatactacacagtaccgtccggtagaaacgggtccgattccgacctatactcaagaagacaattaccaacgaaacactattagtatacttacaaatagaaataaccgtagagagaccgaggacacggccagtatatactgtgtgggctattactacgccccgtaggggcccgggtaaccgtcggtaccgtacccgtcctacccccacccgtacccaaccccgg

SEQ ID NO: 416292 - DNA, 571 bp, Homo sapiens
  misc_feature: GZ8MTXP02GBBRF.22.85.H08.1.454.CMB.2.raw
  modified_base (400)..(400): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagccgtgggggtcccgtgagactctcctgtgcagtctcttgggttcgtcagtggcgactacatgagcgtcgggtccgccgaggcctccgaggggagggccgtggagtggatctctacttatttataggtggtcggtaccacatactacacagctccgtagaagggccgattcaccatctnaagaagacaattcccaaggaacctacattgtatacttacaaatagaaactaacctagaagacgacccgaggacacggcatcgtattacgtgtggtggctatttacgtcggaccccgtgggggacccgggtaaccgtcggtccacccgttccctccccacccgtcaacccgg

SEQ ID NO: 416293 - DNA, 566 bp, Homo sapiens
  misc_feature: GZ8MTXP02I6UPI.22.85.H08.1.454.CMB.2.raw
  modified_base (291)..(291): a, c, t, g, unknown or other
  modified_base (349)..(349): a, c, t, g, unknown or other
  modified_base (387)..(387): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccnccaggctccgaggggaggcctggagtggatcgtcacttatttatagtggtcggtaccnatactacacagactccgtgaagggccgattcaccatcncagaacgacaattcccaaggaacactattgtactcttacaaattgaaattaaccgtagagagccgagacacggcatgtattactgtggtgggctagtttacttcgaccccgttcgggggacccggggaacccgttcgggtccctacccggtccctacccccgaccctaccgaaccccgg

SEQ ID NO: 416294 - DNA, 533 bp, Homo sapiens
  misc_feature: GZ8MTXP02JZ0XJ.22.85.H08.1.454.CMB.2.raw
  modified_base (336)..(336): a, c, t, g, unknown or other
  modified_base (520)..(520): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagcgtgggttttcctgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaaggcctggagtggatctcacttatttanagtggtcgtaccacatactacacagctccgtgaacggccgattcaccatctcagaagacaaattccaggaacacattgtatcttacaaatgaaataacctgagagccgaaggacacggccatgtattactgtgtgggctatttactcgaccccgtggggacccgggaacctggtcaccgtcccnccccacctccacg

SEQ ID NO: 416295 - DNA, 568 bp, Homo sapiens
  misc_feature: GZ8MTXP02GALRJ.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtggttcgtcagtggcgactacatgagcgtgggtcccgccgaggcctccgaggggaagggcctggagtggatctctacttatttatagtggtggtaccacatactacacagactccgtgaacgggccgattcacctatcctcaagaagaacaattcccaaggaacacaattgtatacttacaaatagaaataacctagaagagaccgaggacacggccatgtattactagtgtggggctagttacttcgacccgtcggggcccgggaacccgtcggtaccgacccgtcctacccccgaccctccaaccccg

SEQ ID NO: 416296 - DNA, 539 bp, Homo sapiens
  misc_feature: GZ8MTXP02JS3LF.22.85.H08.1.454.CMB.2.raw
  modified_base (291)..(291): a, c, t, g, unknown or other
  modified_base (348)..(348): a, c, t, g, unknown or other
  modified_base (521)..(521): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgcagtggcgactacatgagctgggtccncaggctccgaggggaaggcctggagtggatctcactttattatagtggtcgtaccanatactacacagactccgtagaacggccgattcaccatctcagaagacaattcccagaacacattgatcttacaaatgaactaacctgagagccgaagacacggcagtgtatactgtgtgggctagtttactcgaccccgtgggggacccgggaaccctgggtaccaccgtccnccccaccctccaacccgg

SEQ ID NO: 416297 - DNA, 533 bp, Homo sapiens
  misc_feature: GZ8MTXP02FUMN6.22.85.H08.1.454.CMB.2.raw
  modified_base (347)..(347): a, c, t, g, unknown or other
tcagacatacgcgtcacgaccggtgctcgatttagtatcactcagtcgcgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccaggggaagggcctggagtggatctcacttattatagtggtggtaccanatactacacagctccgtgaaacgggccgattcacatctcagagacaattccaggaacacattgtatcttacaaatgaaactaacctgaagagaccgaggacacggccatgtattactgtgtgggcatttactcgacccgtggggaccgggaaccgtggtacaccggtcctcccgaccctcaacccg

SEQ ID NO: 416298 - DNA, 587 bp, Homo sapiens
  misc_feature: GZ8MTXP02JCR7K.22.85.H08.1.454.CMB.2.raw
  modified_base (292)..(292): a, c, t, g, unknown or other
  modified_base (348)..(348): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccncaggctccgaggggaaggcctggagtggatctcacttattatagtggtggtaccanatactacacagctcgtagaacgggccgatcatcatctcagaagacaacttcaggaacactatagtatctacaaatgaaactactagagagccgaggacacggccatgtacttacgtgtaggtcggggtactacgtttaccgttacggtaacccccggtacggggggtaaccccgggggtaaaccccgtcggggtacccgacccggttaccccttaccccccgaaccccgtttacccccg

SEQ ID NO: 416299 - DNA, 599 bp, Homo sapiens
  misc_feature: GZ8MTXP02IMREZ.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccggtcgggggtcctgagactctcctgtgcagtctcgtgggttcgtcaggtggcgactacatgagcgtcgggtcccgcgaggctaccggaggggaacgggccgtggaggtggatcgtactactttattagtaggtggtacggtaccactatactacacacgtccgtccgtaggaacgggccgtacttcacctatcctcaagaacgaacaattacccgaaaggaaccaactagttagtaactcttaaacaaatagaaacttaccgtgagacgaccgagaccacggacatagtattacgtgtggtgggacttattacgtcgacccggtggggacccggtaaccgtcggtccaccgtcctaccccacctaccgaacccgg

SEQ ID NO: 416300 - DNA, 573 bp, Homo sapiens
  misc_feature: GZ8MTXP02GWCE5.22.85.H08.1.454.CMB.2.raw
  modified_base (294)..(294): a, c, t, g, unknown or other
  modified_base (352)..(352): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactgggaggaggcttgatccagccgtgggggtccctgagactctcctgtgcagtctcgtgggttcgtcagtggcgactacatgagctgggtccnccgaggctccgagggaaggcctggagtggatctcacttattatagtggtgtaccccanatactacacagactccgtagaacgggccattccaacatctacagaagacaattccaagaacacattagtatcttacaaatgaaataacctagagagaccgaggacacggccatgtatactgtgtggggctagtttacgtacgtaccccgtcgggggcccggggtaaccgtcggtaccgacccgttacccgtcccccacccgtacccaacccgtaacccggg

SEQ ID NO: 416301 - DNA, 688 bp, Homo sapiens
  misc_feature: GZ8MTXP02JJ6DK.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccgaggggacggccgtggagtggatctctactttatttataggtggtcgtaccacatactacacagactccgtagaacggccattcaccatctcaagaagactaattcccgaaggaaccactagtttgtaacttactttaaacaaaattacggaaaacttaacccgtaggaacggtaacgccccgggaaagggacctaaccggggcctaattacggtttaaacttaaccgttagggttcggggtacgggggacctttaaagtttttaacccggtccgggtaacccccccgggttgggggggtacccccgggtaaacccgttcgggggtaccccaccccgggttacccctacccccccgaccccgttaccccgaaaacccccggg

SEQ ID NO: 416302 - DNA, 573 bp, Homo sapiens
  misc_feature: GZ8MTXP02JB4UL.22.85.H08.1.454.CMB.2.raw
  modified_base (357)..(357): a, c, t, g, unknown or other
  modified_base (451)..(451): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccgaggggaacggcctggagtggatctctacttattatagtggtcgtaccanatactacacagctccgtagaacggccgtattcacatctcaagaagactaattcccaaggaaccatattgtatcttaacaaattgaaacttaacngagacgccgaaggacacggcctagtgtaattacgtgtggtgggtactagtttacgttcgaccccggtcgggggacccggtaacccgtggtaccacccgtcctcccccacccgtccgaacccg

SEQ ID NO: 416303 - DNA, 637 bp, Homo sapiens
  misc_feature: GZ8MTXP02H8Q8Z.22.85.H08.1.454.CMB.2.raw
  modified_base (355)..(355): a, c, t, g, unknown or other
tcagacatacgcgtcacgaccggtgctcgatttagtatcactcagtcgcggggggagaggagcccagcactgggattccgaggtgttcccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctctgtgcagtctcgtgggttcgtcgagtggcgactacatgagcgtgggtccgcaggctcccgaggggaacggcctggagtggatctacacttatttagagtggtacgtaaccanatactacacagcctcgtagaacggccgattcaacctatacctacgaaagtaaacgaactaaacttcccgaaaggaaaacctacgtaatttacgtattaccttaaacaaaagtttaggaaaactttaaaccaggaacggtaacggaccgaaagggtaccaacgggtaccaattcggtaattacgtggtaggtggggacttagtttaccgtcggaccccggttggggaccccggggaaccttcgggacctacccggtccctacccccgaacctacccaacccgg

SEQ ID NO: 416304 - DNA, 545 bp, Homo sapiens
  misc_feature: GZ8MTXP02GIMPN.22.85.H08.1.454.CMB.2.raw
  modified_base (370)..(370): a, c, t, g, unknown or other
  modified_base (421)..(421): a, c, t, g, unknown or other
  modified_base (449)..(449): a, c, t, g, unknown or other
  modified_base (476)..(476): a, c, t, g, unknown or other
tcagacatacgcgtcacgaccggtgctcgatttagtatcactcagtcgagggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccgaggggaagggcctgggagtggatctctactttattatagtggtgtaccactatactacacanctcgtgaagggccatcacatctacagaagacaacttccgaagaacacattntatcttaacaaatgaaataacctgaganaccgagacacggacatgtatactgtgngggctattactcgacccgtggggaccggaaccgtcggtaccaccgtccctaccccaccctccaacccgg

SEQ ID NO: 416305 - DNA, 608 bp, Homo sapiens
  misc_feature: GZ8MTXP02HVGS7.22.85.H08.1.454.CMB.2.raw
  modified_base (264)..(265): a, c, t, g, unknown or other
  modified_base (279)..(279): a, c, t, g, unknown or other
  modified_base (292)..(292): a, c, t, g, unknown or other
  modified_base (306)..(306): a, c, t, g, unknown or other
  modified_base (313)..(313): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcggtggtttcgtgtaggctattacaaaaggtgtccagtgtgaggtgcagttggtggagatggaggaggcttgatccagcctggggggtccctgagactctctgtgcagtctctgggttccgnngtgcgactacatgngcgtcggtcgcgngcgcgaggaggcgnggagtgntctctacttattagtagtggtacgtacactatactacacacgcgtacgtacgacggaccgtactacaccactactacaagaaacgaacaaactaaccgaacgaactaactattagtacttacttaactaaataagtaaactaacgtagaggacgacgaacggacgacgacatagtattacgtcggtggtaggtacgtacgttacgttaccggtacccggtaccggggtacccggggtaacccggtaccggtaccgtacccgtacccgtacccccgtaccccgtacccgtaacccg

SEQ ID NO: 416306 - DNA, 553 bp, Homo sapiens
  misc_feature: GZ8MTXP02F8I5M.22.85.H08.1.454.CMB.2.raw
  modified_base (429)..(429): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtggtttccttgttgctattcaaaaggtgtccagtgtgaggtgcagttggtggagactggaggaggcttgatccagcctgggggtccctgagactctcctgtgcagtctcgtgggttcgtcagtggcgactacatgagctgggtccgccaggctccgaggggaaggcctggagtggatctctactttattatagtggtcggtaccactatactacacagactccgtagaacggccgattcaccatctcagaagacaataccagacactattgtatctacaaagtanaactaacctagagacgacgaggaacacgacatagtatacgtgtgtgggtactagttactcggaccccgtggggacccgggaaccgtcgacgtacccgtccgtccccgtaccctcccaaacccgg

SEQ ID NO: 416307 - DNA, 556 bp, Homo sapiens
  misc_feature: GZ8MTXP02GNWZP.22.85.H08.1.454.CMB.2.raw
  modified_base (389)..(389): a, c, t, g, unknown or other
  modified_base (393)..(393): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctggggtcccgccaggctccgaggggaacggcctggagtggatctcactttatttatagtggtcgtaccatatactacacagctccgtgaggccatcacatctnaganacaatcagacactatgtatcttacaaatgaatactgagagccgaggacacggcatgtattacgtggtggtggggctagtttacgtcgacccccggtgggggaccccggggaacccgttcgggtacctacccggttcctacccccacccgtacccgaaccccgg

SEQ ID NO: 416308 - DNA, 569 bp, Homo sapiens
  misc_feature: GZ8MTXP02H5KQ9.22.85.H08.1.454.CMB.2.raw
  modified_base (338)..(338): a, c, t, g, unknown or other
  modified_base (424)..(424): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccgaggggaagggcctggagtggatctcacttatttanagtggtggtaccacatactacacagctccgtgaagggccgattcacatctcagaagacaattccaggaacacattgtatcttaaanaaatagaaactacagagagaccgagacacgacatagtattacgtggtggtgggtacttagtttacgtcggtaccccggtcgggggacccggggtaacccgtcgggtacccgtacccgtcccctacccccaccctacccgaacccg

SEQ ID NO: 416309 - DNA, 564 bp, Homo sapiens
  misc_feature: GZ8MTXP02HJUE9.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatgtagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaagggcctggagtggatcgtcacttatttataggtggtcggtaccactatactacaacagcctccgtaggaaacgggccgattcacctatctcaagaagacaattccaaggaacacattgtatctacaaatgaaataacctgagagaccgaggacacggcatgtattactagtggtggggtctatttacgtcgtaaccccgtgggggacccggggaacccgtggtaccacccggtcctcccccaccctaccaaccccgg

SEQ ID NO: 416310 - DNA, 533 bp, Homo sapiens
  misc_feature: GZ8MTXP02JE75L.22.85.H08.1.454.CMB.2.raw
  modified_base (294)..(294): a, c, t, g, unknown or other
  modified_base (519)..(519): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccnccaggctccgaggggaagggcctggagtggatcgtcactttatttatagtggtcggtaccacatactacacagactccgtggaaacgggccgattcaccatcgtcagaagacaattccaggaaccacattgatcttacaaatgaataacctgagagccgagacacggcatgtatactgtgtgggctatttactcgacccgtggggccggaaccgtggcaccgtcncccacctcaacccg

SEQ ID NO: 416311 - DNA, 682 bp, Homo sapiens
  misc_feature: GZ8MTXP02IAZHJ.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggtcccgcaggctccgagggaaggcctggagtggatctcacttatttagtaggtggtcggtaccacgtactactacaaccaacgtacctcccggtagaaacggggcctaattccgaccatcctacgaagaagaactaaacttcccgaaaggaaaccaactatttagtaacttcttaaacaaaattagaaaacttaaaccctagaagacggccgaaaggaccgacgggaccctaagttcgtaaactttacgtacggtagggttcggggtacttaagtttaaaccgttccggaacccccgggttcgggggacccccggggtaaaaccccggttcggtacccgtaaaccccggttccccgtaccccccccgtaacccgttcccccgaaaacccccggg

SEQ ID NO: 416312 - DNA, 658 bp, Homo sapiens
  misc_feature: GZ8MTXP02HRAFY.22.85.H08.1.454.CMB.2.raw
  modified_base (352)..(352): a, c, t, g, unknown or other
  modified_base (378)..(378): a, c, t, g, unknown or other
  modified_base (406)..(406): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtcccgccgaggcctccgaaggggaacgggccgtgggaagtggattctacactttatttanaggttggtcgtaaccactatacctanacagcctcgtagaacggccattcaaccntctacaagaaacgactaattccgaaggaacaactatttacgtattacttaacaaatacgtaaattaaaccgagaaggacgacccggaggaaccgacggacctaagttacgtaagttacgtggtacgggttcgggaacttatttacccggtttacggaccccccgggttagggggacccccggggtaaacccgttcgggtaaccctacccccggttcccgtaccccccaacccccgttacccgaaacccccgg

SEQ ID NO: 416313 - DNA, 616 bp, Homo sapiens
  misc_feature: GZ8MTXP02HRZKO.22.85.H08.1.454.CMB.2.raw
  modified_base (402)..(402): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgaggggaacgggcctgggagtggatcgtactactttatttagtaggtggtacggtaccacatactacacagcctccgtagaacgggcctattcaccntctacaagaagaacaattaccaagaacactattagtatactactaaatagtaaataacctagaggacgacgaacggacacggaccagtagtacgttactggtggtaggggtactacgtttacgtaccgtaccccggtacgggggaccccggggtaacccgttcggtaccccgtacccgtacccgtacccccgtaccccgtacccgaaaccccgg

SEQ ID NO: 416314 - DNA, 624 bp, Homo sapiens
  misc_feature: GZ8MTXP02FN5L3.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagttctcgtgggttcgtcaggttggcgactacatgagcgtgggtccgccaggctccgaggggaggcctggagtggatctcgtactttatttagtagttggtacggtaacccacgataccgtacacaagtacctccggtaggaaacggggcccgtaattccaacctatactaccagaaagaaccaaattcccgaaggaaccaacgtaattagtaaatacttacaaatagaaactaacctagtaacgagacccggaggaaccacgggacccatagtacttacgtgttcggtacggggacctagtttacctcggaccccgttgggggacccggggtaacctcgggtaccacccggtcctccccaccctccgaacccg

SEQ ID NO: 416315 - DNA, 540 bp, Homo sapiens
  misc_feature: GZ8MTXP02GQ4MV.22.85.H08.1.454.CMB.2.raw
  modified_base (335)..(335): a, c, t, g, unknown or other
  modified_base (349)..(349): a, c, t, g, unknown or other
  modified_base (437)..(437): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttggatccagcctggggggtccctgagactctcctgtgcagtctctgggttcgtcagtggcgactacatgagctgggtccgcaggctccgagggaaggcctggagtggatcgcacttattanagtggtcgtaccanatactacacagctccgtgaagggccattcacatctcagaagacaattcccaaggaacactattgtatcttacaaattgaaattaaccngagagaccgaaggacaacggccatcgtatactgtgtgggctattactcgacccgtggggaccgggaaccctggtccaccggtcctaccccgacctaccaaccg

SEQ ID NO: 416316 - DNA, 762 bp, Homo sapiens
  misc_feature: GZ8MTXP02JXB8S.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctggagcttgggttttccttgttgcttatttacaaaaggtgtccagtgtgaggtgcaggttggtggagacgtgggaggaggcttgatccagccggtgggggtcctgagactctctgtgcagtctcgtgggttctcgaggtggcgactacagtggagcggtcggggtccccgccgaggcctacccggaaggggaacggggtcccgtgggaggtggtacttccgttactaacttttaattttaagtagggttggttaccggtacccaactacttaacctacaacgacgtaccgtccggtagggaaaccggggtcccgtattaccaaccctattcccgtacaaaggaaacgtaaacctaaacgttacccgaaaggaacctaacttaagttacgttacttacctttaaacaaaagttacgtaaaacttaaaccgttaggaacggaacggaacccggaaacgggaacccgaaccgggtaccctagttagttaacttaacgttgggttgggtcgggggtacttaacgttttaccgttacccggtaaccccgggtcgggggtaccccggggtaacccggttcggtacccgtaccccgtccccgtaccccccaccccgtacccaaaccccggg

SEQ ID NO: 416317 - DNA, 536 bp, Homo sapiens
  misc_feature: GZ8MTXP02FUHDX.22.85.H08.1.454.CMB.2.raw
  modified_base (292)..(292): a, c, t, g, unknown or other
  modified_base (327)..(327): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctggggtccnccaggctccgaggggaagggcctggagtggatctntacttattatagtggtggtaccacatactacacagctccgtgaaagggccgattcaccatctcagaagacaattcccaaggaacacattgtatcttacaaaatgaaataacctgagagaccgagacacggcatgtataactgtgtgggctagtttactcgacccgtggggaccggaacctggtcaccgtcctacccacccgtcaacccg

SEQ ID NO: 416318 - DNA, 626 bp, Homo sapiens
  misc_feature: GZ8MTXP02F8RWU.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcgaggctccgaggggaagggcctggagtggatcgtctacttatttatagtggtcgtaccacatactacacagacgtccgtagaacggggccgtattacaccatctacaagaaagacaaattccgaagaacactattgtatcttaacaaaatagaaattaaccgtgaaggaacgacccgaggaccaaccggacctagtacgtaattactggtaggtggggacttaacgtttacgttcggtaaccccggtcgggggtacccccgggggaaacccttcggggtaccctaacccgggttccctaccccccgtaaccccgtcccgaaaacccccgg

SEQ ID NO: 416319 - DNA, 634 bp, Homo sapiens
  misc_feature: GZ8MTXP02HA5FM.22.85.H08.1.454.CMB.2.raw
  modified_base (462)..(462): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcgaggctccgaggggacggcctggagtggatcgtctacttatttatagtggtcggtaccactatactacacagactcgtagaacgggccagttcactatctacaagaagactaattcccgaaggtaaaccactattagtatcttaacaaaagttgaaactttaaccnggaagacggacccgaaggaaccgacggacctaagttagtaattacgtaggtaggttcggggacttaagttttaaccgtccggaacccccggttcggggggaacccggggtaaccccgtggtaccccgtaaccccggttccctaccccccgtacccgtacccccaaacccggg

SEQ ID NO: 416320 - DNA, 626 bp, Homo sapiens
  misc_feature: GZ8MTXP02HBFBP.22.85.H08.1.454.CMB.2.raw
  modified_base (262)..(262): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtgggtttcctgtgctattacaaaggtgtccagtgtgaggtgcagttggtggagactgggaggaggcttgatccagccgtgggggtcctgagactctcctgtgcagtctcgtgggttcncagtggcgactacatgagcgtcgggtccgccaggctcccggaggggaacggcctgggagtggactctctacgtttattataggtggtacggtaccactatactacacacgactccgtaggaacgggcctattaccacctattcccaacaagaacaactaactaccgaagaacatattatactactaaataatagaactaacgagacgaacgacgaacggacgtacgactagttacgtacttacgtcggtaggtacgggtacttacgtttaccggtaccggtaccccggggtacgggggacccggtaaccggttccggtacccgtacccgtaccccctacccccgtaccccgtaccgaaccccgg

SEQ ID NO: 416321 - DNA, 595 bp, Homo sapiens
  misc_feature: GZ8MTXP02FSTGN.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggttgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccgaggggaaggccgtggagtggatctctactttatttatagtggtgtaacccacatactacacagactccgtagaacgggccattcaccatctacagaagacaactacaagaacactattagtatactactaaatagaaactaactagtagagacgacgacgacgaccgataggggggtattacgtagtcggtgggtacgtactttacgttacgtacccggtccggggaccggggacccgtcggtcccgtaccgtacccgtaccccctaccctacccgacccgaacccgg

SEQ ID NO: 416322 - DNA, 682 bp, Homo sapiens
  misc_feature: GZ8MTXP02GJYQ8.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccaggctccgaggggagggccgtggagtggctctactactttattagtggtggtaccgtaccagtactacacacgacgtccgtcgagggacggctacgtaccactactctacgaacgaacgaactaacgtacccgaaacgaaccacgttagttactacttaccttaaaataagttaaacgtaaacttaaccgtagaacgggaccgaccgggaacgaaccggacgtaactacgtttagttaacgttaacggttggtacggggtcgggtaacttttaacggtttaccggtacccgggttaccccgggggtaccgggggtaccccgggttaaccgtcggtaccccgtacccggttcccccacccccgtaccccgtacccgaaaccccggg

SEQ ID NO: 416323 - DNA, 587 bp, Homo sapiens
  misc_feature: GZ8MTXP02GK027.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctggggtcccgcaggctccgaggggaggcctggagtggatctcacttatttagtagtggtacgtaccacatacctacacagctccgtaggaacggcccgattcaccatctcaagagaacaattccaaggaacactattgtactcttacaaaattgaaacttaaccgtgagagccgaaggacacggccatgtattacgtggtaggtggggtctagtttacgttacggacccccgtgggggaccccggggaaccgtcgggtaccctacccggtccctacccccgacccgtacccaaaccccgg

SEQ ID NO: 416324 - DNA, 633 bp, Homo sapiens
  misc_feature: GZ8MTXP02J2ZHO.22.85.H08.1.454.CMB.2.raw
  modified_base (340)..(340): a, c, t, g, unknown or other
  modified_base (356)..(356): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggcctccgaggggaaggcctgggagtggatcgtcacttatttanagtggtacggtaccanatactacacagcctcgtagaagggccgattcaaccatctacaagaacgactaaacttccgaggaacactattagtacttcttacaaatagaaactaaccgtgaacggacgaccgaaggaacaccgggtaccatgtaacttacgtggtaggtacgggggcttaactttaccgttcgggaaccccccggttggggggacccccgggggtaacccgttccggggtaccccgtacccggttacccctcccccgtaaacccccggttcccaaacccccgggg

SEQ ID NO: 416325 - DNA, 693 bp, Homo sapiens
  misc_feature: GZ8MTXP02HKA16.22.85.H08.1.454.CMB.2.raw
  modified_base (485)..(485): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggcctccgaggggaacgggcctgggagtggatcgtactactttatttagtaggtggtacggtaccacgatactacacgagaccgtccgtaggaaacggggtccgactttaccaaccctatcctacaaacggtaaacgaactaaactttaccccgaagggtaaaccactaatttgtaacttaccttaanaaaattacgaaacttaaaccgtggaacggacgacccggaaggaaccaccggaccaattacgtattaacgtcgtaggttcggggtacttaacgttttaacgttccggaacccccggttcggggggaccccgggggtaaaccccgttcggggtacccgttaacccccggtccccttaccccccgaaccccgttaccccgaaacccccggg

SEQ ID NO: 416326 - DNA, 571 bp, Homo sapiens
  misc_feature: GZ8MTXP02HC6UV.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggcctccgaggggaacgggcctgggagtggatctctactttatttataggtggtcggtaccagtatactacacagacctccggtaggaacgggccgattccgacatctacagaaagacaattcccgaggaacactattagtatcttacaaattagaactaacctgagagccgagacacggcatgtatacgtgtggtgggactattacgtcgaccccgtggggacccgggtaaccgtcggtaccgaccgtccctaccccgaccctccaacccgg

SEQ ID NO: 416327 - DNA, 593 bp, Homo sapiens
  misc_feature: GZ8MTXP02H3CHQ.22.85.H08.1.454.CMB.2.raw
  modified_base (295)..(295): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccncgaggctccgaggggaaggcctggagtggatctcactttaatttagtagtggtacgtaccactatactacacacgtctccgtagaacgggccgtattccacctaatcctacaagaaagaactaaattccgaaggaaaccaactattagtatacttacaaaattgaaacttaactagagacgacgagacacggcagtgtattactggtgtgggactacgtttacgttcgaccccgtcgggggacccgggtaacccgtggtaccctaccggtccctacccccgaccctacccgaacccgg

SEQ ID NO: 416328 - DNA, 647 bp, Homo sapiens
  misc_feature: GZ8MTXP02HZ8VE.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcgaggcctccgagggacggccgtggagtggatcgtctactttatttagtaggtggtccggtaccacgtaatactacaacaggtacctccggtagaaacggggcctaattccaacctactcctacgaaagaaacgaactaaacttccgaaaggaaaccactaattacgttattacttaactaaaattgtaaaacctttaacgagaaggaacgaccgaaaggaccacgggactaatgtaaacttagtggtaggtcggggacttagtttaccgttcggaacccccggttcgggggaccccgggtaaccgtcggtacccgaccgtccccgtacccccgacccgtcccgaaacccgg

SEQ ID NO: 416329 - DNA, 484 bp, Homo sapiens
  misc_feature: GZ8MTXP02I7KCV.22.85.H08.1.454.CMB.2.raw
  modified_base (467)..(484): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaaataacctgagagccgaggacacggccatgtattactgtgtggggctatttacttgaccccgtggggccgggaccctggtcaccgtctccccaccctccaccaggcccatctgtcccttccccgtggccacccctcctccaagcgccacccgtcgtcgggggccacgacgccggtccccgtggggcctcggtccgtcgggtaccgaaacgggtacctacttcccgaaccgtcgtagtcgtcgtggacggccggggcgtcgggacgaaggggccgacataggnnnnnnnnnnnnnnnnnn

SEQ ID NO: 416330 - DNA, 540 bp, Homo sapiens
  misc_feature: GZ8MTXP02F8DV9.22.85.H08.1.454.CMB.2.raw
  modified_base (388)..(388): a, c, t, g, unknown or other
  modified_base (461)..(461): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctccgagggaagggcctggagtggatcgtctacttatttatagtggtcgtaccacatactacacagactccgtgaggccgattcacatctnagaagacattcagacacattgatcttcaaattgaataacctgaagagccgaggacacggccatgtattactgngtggggctatttactacgtacccgtcggggcccgggaacccgtggtcctacccggtcctcccccaccctcccaacccgg

SEQ ID NO: 416331 - DNA, 604 bp, Homo sapiens
  misc_feature: GZ8MTXP02IPYWC.22.85.H08.1.454.CMB.2.raw
  modified_base (352)..(352): a, c, t, g, unknown or other
  modified_base (382)..(382): a, c, t, g, unknown or other
  modified_base (467)..(467): a, c, t, g, unknown or other
tcagacatacgcgtcacgaccggtgctcgatttagtatcactcagtcgcggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtcttcgtgggttctcgagtggcgactacatgagcgtgggtcccgccgaggcctccgaggggaacggccgtgggagtggattcgtctaactttatttanaagtggtacggtaccaacatactacacganaccttccgtagaaggcccgattccaaccgtatactaccaagaacgaacaacttacccaaggtaaaccagtattagtatccttaanaaattagaaacttaaccagagacgaccgagacacgcgatcgtatactgtagtgggtactattacgtacgacccgttggggacccgggaacctcggtaccgacccgtccgtccccccgaccgttacccgaaaccccgg

SEQ ID NO: 416332 - DNA, 720 bp, Homo sapiens
  misc_feature: GZ8MTXP02H939M.22.85.H08.1.454.CMB.2.raw
tcagacatacgcgtcacgaccggtgctcgatttagtatcactcagtcgcggggggagaggagcccagcactgggattccgaggtgttcccattcggtgatcagcactgaacacagaggactcaccatggagttttggctgagctgggttttccttgttgctatttcaaaaggtgtccagtgtgaggtgcagttggtggagactgggaggaggcttgatccaggccgtgggggtccctgagactctcctgtgcagtctcgtgggttcgtcagtggcgactacatgagcgtgggtcccgcgaggctccgaggggaacggccgtggagtggatcgtactactttatttaacgtaggttcggtcggtaacccaactactaacctaacaacgagtaccgtccggtaggaaacgggggtccctaattcccaacctaactcctacgaagaaagaacctaaacgttacccgaaaggtaaacctaacctaagtttacgttaacttaccttaaactaaattacgtaaaactttaacccgtaggaacggacggacccggaaacggacgaccgggacctaagttattaacgttaacgttggttcggttacggggtcttaaacgttttaccgttaccggtaacccccgggttcgggggaccccggggttaacccgtcggggtaccctacccggttccccgtacccccccgtaccgtacccccgtaaaccccgg

SEQ ID NO: 416333 - DNA, 682 bp, Homo sapiens
  misc_feature: GZ8MTXP02IF11P.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgccgaggcctccggaggggaacggggccgtgggagtggatccttactactttatttagtaggtggtaccggtacccactataacctacacacgcctccggtaggaacggggtccctaatttccaacctacgtcctacaaaggaaacgaactaaacttacccgaaaggtaaaccaactaagtttacgtaacttacctttaaacaaaattagtaaaacttaaaccgtagaagtacgaccggaaggaaccgaccggacctagtacgtattacgttggtggtgggacttaagtttaccgttccggtaccccggtcgggggaccccggggtaacccgttcgggtacccgtaccccggtccctaccccccgaccccgtacccaaaccccggg

SEQ ID NO: 416334 - DNA, 725 bp, Homo sapiens
  misc_feature: GZ8MTXP02ISBXC.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagctctcctgtgcagtctcgtggttcgtcagtggcgactacatgagcgtcgggtcccgcgacggctccggaaggggaacgggccgtgggaggtggactctctactttaatttagaggttggtaccgtaaccactatactacacacgtactccggtaggaaacgggccctaattccaacctatacctacgaaagtaaacgaactaaacgttacccgaacggaaaccaactaagtttacgtattacttaaactaaaatagtaaaacttaaacctaggacgaacgacccggaggaacccgaacgggactaagttacgttaacgttacgttacggtagggttacgggggtacttaaacgtttttaccggtacccggtaacccccgggttacggggggacccccggggtaaaccccggttacggggttacccccgtaaccccggttacccccgtaccccccgttaacccccgtaccccgtaaaacccccggg

SEQ ID NO: 416335 - DNA, 550 bp, Homo sapiens
  misc_feature: GZ8MTXP02GWF9P.22.85.H08.1.454.CMB.2.raw
  modified_base (296)..(296): a, c, t, g, unknown or other
  modified_base (362)..(362): a, c, t, g, unknown or other
  modified_base (487)..(487): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccnccaggcctccgaggggaagggcctgggagtggatcgtctactttatttataggtggtcggtaccanatactacacagactccgtaggaaacgggccgattccaccatcctcaagaagacaattccaaggaacacattgtatcttacaaatgaatacctgagacgacgaggacacggcatgtatacgtgtgngggctattcttcgacccgtggggcccggaaccgtggccaccgtcctaccccacctccaacccg

SEQ ID NO: 416336 - DNA, 587 bp, Homo sapiens
  misc_feature: GZ8MTXP02IK30M.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtggggtcccgccaggctccgaggggaagggcctggagtggatctcacttatttataggtggtcggtaccacatactacacagactcgtggaacggggccattcacatctcagaagacaattcccaaggaacactattagtactcttacaaaatagaaacttaacccgagacgaccgacgacgacgacgactagtagttacgtacgtggtgggtgtacgttacgttacgtcccggtaccgggtccggggacccggtaacgtcgtacccgtccgtcccctacccgtaccctaccgaaacccgg

SEQ ID NO: 416337 - DNA, 603 bp, Homo sapiens
  misc_feature: GZ8MTXP02GU6VX.22.85.H08.1.454.CMB.2.raw
  modified_base (357)..(357): a, c, t, g, unknown or other
  modified_base (390)..(390): a, c, t, g, unknown or other
  modified_base (394)..(394): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcaggtggcgactacatgagcgtgggtccgcaggcctccgaggggaaggcctggagtggatcgtactacttattagtagtggtcggtaccanatactacacagctccgtagacggccatcacctntctnagaagacaatccgagacacattgtatacttacaaatacgtaaactaaccgtgacgacgcccgaaggaccaccggacctattacggtaattacgtggtaggttggggacttaagtttaccgtacggtaacccccggtgggggacccggggaaacccgttcgggtacccaccggttcccctacccccgtaacccccgtcccgaaaccccgg

SEQ ID NO: 416338 - DNA, 718 bp, Homo sapiens
  misc_feature: GZ8MTXP02IRDWE.22.85.H08.1.454.CMB.2.raw
  modified_base (251)..(251): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtggaggaggcttgatccagccgtgggggtcctgagctctctgtgcngtctcgtggttcgtcagtggcgactacatgagcgtcgggtcccgcgacggcctcccgggggggggggaagaacggggcccgtaggggaggtggtaacttcctactacttttaagtttagtaggttggtaccggtaaccactatactacaacagcctccgtaggaacggcctactcaacctatcctacaagaaacgaactaacttacccgaaggaaaccactaattagttacttacttaacaaaagttagtaaaacttaaccgtaggaacggaacgacccggaaacgggaaccgaaccgggtacctaagttagttaacgtttaacgttggttacggggttggggtaacctttaacggtttaaccgttccgggaacccccgggttggggggacccccggggtaaacccgttcgggtacccgtaccccggttcccctaccccccgtaaccccgttaccccgaaaccccgg

SEQ ID NO: 416339 - DNA, 748 bp, Homo sapiens
  misc_feature: GZ8MTXP02HJE94.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgatccagccgtgggggtccctgagactctcctgtgcagtctcgtgggttcgtcagtggcgactacatgagcgtgggtcccgcgaggctccgaggggaaggcctggagtggatcgtctacttatttagtagtggtacggtaccacgtactactacacagacctccggtagaaacggggccgtattaccaacctatcctacgaagaacgaaactaattacccgaaagggaaaccactaatttacgtacttaccgtttaacaaaaagttaggtaaaactttaaacctagggaaacggaacggacccccggaaaggggtaacccgaaccggggaccctaaagtttcggttaaaacgtttaaccggtacggtttgggggttagggggtaaccttaacgtttttaacccggtaccgggttaccccccgggtacgggggggttaacccccgggggtaaacccccgtttggggtaacccccgtaacccccgggttccccttacccccccgaacccccgtttaccccggaaaacccccgggg

SEQ ID NO: 416340 - DNA, 664 bp, Homo sapiens
  misc_feature: GZ8MTXP02F3813.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagacctctcctgtgcagtctcgtgggttctcgagtggcgactacagtgagcgtcgggtcccgccgaggctccgaaggggaacggccgtggagtggactctactaactttatttagaggttggtaccgtaccactatacctacaacgacgcctccggtaggaacgggccgtattccacctatcctacgaagaaacgaaccctaattcccgaaaggaaacctaactaatttgtaaacttcttaaacaaagtagtaaactaaccgtagaagacgccgaaggacacggacagtagtagttacgtgtacggtcgggacttacggtttaaccgtccggaacccccggtcgggggtaacccccgggtaaccgttacgggtacccctaccccggttaccccctacccccgtaaccccgttccccgaaaccccggg

SEQ ID NO: 416341 - DNA, 555 bp, Homo sapiens
  misc_feature: GZ8MTXP02IMYBZ.22.85.H08.1.454.CMB.2.raw
  modified_base (352)..(352): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtcccgccaggctccgaggggaaggcctggagtggatctcacttattatagtggtggtaccanatactacacagactccgtgaagggccattcaccatctcagaagacaattccagaacacattgtatcttacaaatagaaataacctgagagccgaggacacggcatgtattactgtgtggggctagtttactcgtaccccgtggggacccggggaacccgtcgggtacctacccggtcctacccccaccctacccgaaccccgg

SEQ ID NO: 416342 - DNA, 414 bp, Homo sapiens
  misc_feature: GZ8MTXP02GC2EQ.22.85.H08.1.454.CMB.2.raw
  modified_base (381)..(381): a, c, t, g, unknown or other
  modified_base (410)..(414): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctggggccggggaacctggtcaccgtctccccaccctccaccaaggcccatctgtcttccccctggcaccctcctccaagacgcacctctggggcacagcggccctggctgcctggtcaaggactacttccacgcgtntgtctgacgcgggctggcaagcgcatagnnnnn

SEQ ID NO: 416343 - DNA, 697 bp, Homo sapiens
  misc_feature: GZ8MTXP02I2QXI.22.85.H08.1.454.CMB.2.raw
  modified_base (465)..(465): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccgtgggggtccctgagactctcctgtgcagtctcgtgggttcgtcagtggcgactacagtgacgcgtcgggtcccgccgaggcctccggaggggaacgggcctgggaggtggatcgtctactttatttagtaggtggtacgtaccactatacgtacacgagctccgtaggaacgggccgtattacgactatctacaagtaacgaacaacttccgaaagacctacgtattagtatccgttaanaaaagttacgaaaacttaaccgaggaacgaacgacccgggaaagaccaacgggacctaagtacgttaactttacggtggttcggggttacggggtacttaaacgttttaccggttacccgggaacccccgggtttcggggggaaacccccggggtaacccgttcggggttaccccaaacccccgggtttcccctaacccccccgtaccccgttacccgtaaaaacccccggg

SEQ ID NO: 416344 - DNA, 560 bp, Homo sapiens
  misc_feature: GZ8MTXP02GMMY1.22.85.H08.1.454.CMB.2.raw
  modified_base (295)..(295): a, c, t, g, unknown or other
  modified_base (356)..(356): a, c, t, g, unknown or other
  modified_base (398)..(398): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagctgggtccnccaggcctcgagggagggcctggagtggatcgtctactttattataggtggtcggtaccanatactacacagactccgtagaaacgggccctatcaccatctnaagaaagacaatccaagaacactattgatcttaacaaatgaaactaacctgaagagaccgagacacggcatgtatacgtgtcggtgggctagtttactcgaccccgttgggggacccggtaaccgtcggtaccaccggtcctcccccgacctccaaacccgg

SEQ ID NO: 416345 - DNA, 586 bp, Homo sapiens
  misc_feature: GZ8MTXP02HC7JA.22.85.H08.1.454.CMB.2.raw
  modified_base (253)..(253): a, c, t, g, unknown or other
  modified_base (327)..(327): a, c, t, g, unknown or other
  modified_base (405)..(405): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcngtctctgggttcgcagtggcgactacatgagctgggtccgccaggctccgaggggaaggcctggagtggatctnacttattatgtgtcggtacacatactacacagctcgtagaacggccgatcaccatctcagaagacaattccgagaacnctattgtatcttacaaatgaataacctgagacgacgaggacacggctatagtattactggtaggtcggggtactagtttaacgttcggaacccccggttgggggaacccccggggtaaccttcggggtaccccgtaacccggttccccgttacccccaccccgttaccccgaaaccccggg

SEQ ID NO: 416346 - DNA, 572 bp, Homo sapiens
  misc_feature: GZ8MTXP02GFIX1.22.85.H08.1.454.CMB.2.raw
  modified_base (358)..(358): a, c, t, g, unknown or other
  modified_base (401)..(401): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtgggtccgccaggctccgaggggaagggcctggagtggatctctactttatttataggtggtcggtacccanatactacacacgctccgtagaagggccattcacatcacagaanaacattcccaagaacacattgtatcttaacaaatgaaactaacctgagagacccgaggacacggcatagtattacgtgtcgtggggactagtttacgtcgaccccgttgggggacccggtaaccgttcggtaccgtacccggtccttacccccgacccctccaaaccccgg

SEQ ID NO: 416347 - DNA, 550 bp, Homo sapiens
  misc_feature: GZ8MTXP02IJEUP.22.85.H08.1.454.CMB.2.raw
  modified_base (256)..(256): a, c, t, g, unknown or other
  modified_base (529)..(529): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctntggttcgtcagtggcgactacatgagctgggtccgcaggctccgaggggaacggcctggagtgatctcacttatttatagtggtcggtaccacatactacacagctcgtaggaacgggcctagttcaaccatctacagaacgactaattcccaaggacctactattacgtatcttaacaaatagaacttaaccgtgtaagacgaccgagacacggccagtagtatactgtgtagggctagttacgtcgaacccgtggaccggtaacctcggcnccgtctacccacctacgaccg

SEQ ID NO: 416348 - DNA, 627 bp, Homo sapiens
  misc_feature: GZ8MTXP02GHH63.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatgtagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctccgaggggaacggccgtggagtggatctctactttattatagtggtcggtaccactatactacacagaccgtccgtggaacgggccattcacatctacaagaagaacaattacccgaaggaaccaactagtttgtacttacttaacaaatagtaaacttaaccgtggaagacgacccgaaggaccgaccggaccagtacgtattacgtggtcgggtggggtacttagtttaccgtccggaacccccggttgggggaaccccgggtaacccgttcgggtacccgtacccggtcccctacccccgaccccttacccgaacccccgg

SEQ ID NO: 416349 - DNA, 647 bp, Homo sapiens
  misc_feature: GZ8MTXP02IA346.22.85.H08.1.454.CMB.2.raw
  modified_base (452)..(452): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtggggggtccctgagactctcctgtgcagtctctgggttctcagtggcgactacatgagcgtgggtcccgcgaggcctaccgaggggaacgggcctgggacgtggactctctactttatttataggtggtcggtaccactatactacacacgctccgtaggaacggggccagttcacatcctcaagaagacaattcccgaggaaccactattacgtattacctttaaanaaattacgaaacttaacgtaggaacggaaccggaccggaacggaccgacggactagttacgtacttcgtacggttggtacgggtacttacgtttaccgtaccgggtaccccgggtcgggggtacccccgggtaacccgttcgggtaccctccccggttacccctacccccgtaaccccgtacccggtaaacccgg

SEQ ID NO: 416350 - DNA, 594 bp, Homo sapiens
  misc_feature: GZ8MTXP02IEUWW.22.85.H08.1.454.CMB.2.raw
  modified_base (396)..(396): a, c, t, g, unknown or other
  modified_base (402)..(402): a, c, t, g, unknown or other
  modified_base (426)..(426): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtcctgagactctcctgtgcagtctcgtgggttcgtcagtggcgactacatgagcgtcgggtcccgccaggcctccgaggggaacgggcctggagtggatctctactttattagtagtggtcggtaccacatactacacagctccgtaggaacgggcctatcacnctctanagaagacaactccagaacacattntatctacaaatagaaattacagagacgccggaagacacggactatgtacttacgtaggtggtcggggtacttaacgtttacgttccggaccccggttcgggggaccccggggtaacccgttcgggtaccctacccggtcccctacccccgtaccctacccgaaccccg

SEQ ID NO: 416351 - DNA, 435 bp, Homo sapiens
  misc_feature: GZ8MTXP02IHC8E.22.85.H08.1.454.CMB.2.raw
  modified_base (336)..(336): a, c, t, g, unknown or other
  modified_base (395)..(395): a, c, t, g, unknown or other
  modified_base (425)..(435): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggctatttacttgaccccgtggggcccggggaaccctggtccaccgtctccccaccctccaccaacggcccatctcgtccttccccctggccacccctcctccaagacnccacctcgtgggggcacgagccggccctgggctgccgtgcaaggctacttccacgcgtntgtctgagcgggctggcgaagcgacatagnnnnnnnnnnn

SEQ ID NO: 416352 - DNA, 555 bp, Homo sapiens
  misc_feature: GZ8MTXP02FOK18.22.85.H08.1.454.CMB.2.raw
  modified_base (354)..(354): a, c, t, g, unknown or other
  modified_base (431)..(431): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaaggcctggagtggatctctactttattatagtggtcgtaccanatactacacagctccgtgaacggggccattcaccatctcaagaagacaacttccgaaggaacactattgtatctaanaaatgaaataaccgtgagagccgagacaggcatgtatactggtgtgggtactagtttacgtcgacccgtgggggacccggaaccgtggtaccacccggtcctacccccgacctcccgaaacccg

SEQ ID NO: 416353 - DNA, 617 bp, Homo sapiens
  misc_feature: GZ8MTXP02F9VLH.22.85.H08.1.454.CMB.2.raw
  modified_base (401)..(401): a, c, t, g, unknown or other
  modified_base (438)..(438): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggctccgaggggacgggcctgggagtggatctctaactttatttatagtggtcgtaccatatactacacagcctcgtaggaacggccgattccactatccncaagaagactaattcccgaaaggaacctacagtttanacttacttaacaaatagtaaacttaaccgtgaacggacgcccggaaggaccacggtaccagttgttaacttacgtgtgggtacgggcttaaacgtttacgtccggaccccggttgggggacccggtaaacccgtcggtacccaccccggttcccacccccgtaccctacgaaaccccgg

SEQ ID NO: 416354 - DNA, 664 bp, Homo sapiens
  misc_feature: GZ8MTXP02IF2JV.22.85.H08.1.454.CMB.2.raw
  modified_base (324)..(324): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcaggctcgaggaggcctggagtggatctntactttatttagtagtggtcgtaccactatactacacagctccgtagaacggggcctattcactatctacagaacgactaattaccaagaacactattagtaactcttaacaaattagaaacttaaaccgtagaagacggaccggaaggaaccgacgggacctaagttacgttaacgtttaacgttgggttagggttacgggggtactttaacgttttaaccggtttaccggtacccccgggttacgggggtaccccgggggtaaaccccggttcgggttaacccgtacccccgggttcccttacccccccgtaaccccgttaccccgaaaacccccggg

SEQ ID NO: 416355 - DNA, 570 bp, Homo sapiens
  misc_feature: GZ8MTXP02I333N.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtcccgccgaggcctccgaggggaaggccgtggagtggatctctactttatttatagtggtcgtaccacatactacacacgctccgtagaacggccgattcaccatctcaagaagacaattccgaagaacactattagtatcttaacaaatagaaactaacctagagagaccgagacgacgacatacgtattacgtgtagtgggactagttacgtcgacccggtggggacccgggtaacccgtggtaccacccgtccgacccccacccgtaccaacccg

SEQ ID NO: 416356 - DNA, 692 bp, Homo sapiens
  misc_feature: GZ8MTXP02FRPGC.22.85.H08.1.454.CMB.2.raw
  modified_base (369)..(369): a, c, t, g, unknown or other
  modified_base (450)..(450): a, c, t, g, unknown or other
  modified_base (469)..(469): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccaggccgtgggggtccctgagctctcctgtgcagtctcgtgggttcgtcaggtcggcgactacagtgagcgtggggtcccgccgacggctcccggaggggacgggcctgggagtggatctactacttatttataggtggtcgtaccanactactaacacagcctcgacggaacgggcctattccaaccattccacaagaagaactaattcccgaaagaaccatagtttntaactcttaaacaaaagtntaaaactaccgtggaacgacgaccggaaggaccacggtcctaagttagtaacgtttacggtggtacgggttacgggggtaccttaacgtttttaccggttacccggggaaccccccgggttcgggggggtacccccggggtaaaaccctttccgggggtacccctaaacccccgggtttcccccgtaacccccccaacccgtttcccccgaaaacccccgggg

SEQ ID NO: 416357 - DNA, 607 bp, Homo sapiens
  misc_feature: GZ8MTXP02JMZ5C.22.85.H08.1.454.CMB.2.raw
  modified_base (336)..(336): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagcgtgggtccgcgaggctccgaggggaggcctggagtggatctctacttattanaggtggtcgtaccatatactacacagcctccgtagaacgggccgattcaccatcctcaagaacgactaattacccaaggaacactagttacgtattccttaacaaatgaaacttaaccgtagaacgacgaccgaggaccacggccagttacgtaattacgtaggtcggtaggggtactaagtttaccgtaccgaccccgggttgggggaccccgggtaacccgtcggtaccctacccggtccctacccccgacccctacccgaaaccccgg

SEQ ID NO: 416358 - DNA, 619 bp, Homo sapiens
  misc_feature: GZ8MTXP02JOFHL.22.85.H08.1.454.CMB.2.raw
  modified_base (352)..(352): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagctgggtcccgcaggctccgaggggaggcctggagtggatctcactttattagtagtggtacggtaccanatactacacagactccgtagaacgggcctattcaccatctcagaaacgactaaacttccgaaggaaccactatttagtacttacttacaaattagaaacttaacctagaggacgaccggaagacgtaccggacattacgtaattacgtggtaggtaggggtaccttaacgtttacgtaccggtaccccggttcgggggaccccggggtaacccgtcgggtacccgtacccggtacccctacccccgtacccctaccgaaacccccgg

SEQ ID NO: 416359 - DNA, 574 bp, Homo sapiens
  misc_feature: GZ8MTXP02FNXE9.22.85.H08.1.454.CMB.2.raw
  modified_base (353)..(353): a, c, t, g, unknown or other
  modified_base (364)..(364): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcttggggttcgtcaggtggcgactacgatgagctgggtccgccaggctccgaggggaggcctggagtggatctcactttattatagtggtgtaccanatactacacanctccgtagaagggccgattcaaccatctacagaagacaattcccaaggaacacattgtatcttacaaatgaataacctgagacgccgaggacacggtccatagtattacgagttggtaggggtctaatttacgttcggaacccccgtgggggtacccggggaacccgtgggtacctacccggtccctcccccgaccctcccaaaccccgg

SEQ ID NO: 416360 - DNA, 603 bp, Homo sapiens
  misc_feature: GZ8MTXP02FSPAX.22.85.H08.1.454.CMB.2.raw
  modified_base (424)..(424): a, c, t, g, unknown or other
  modified_base (452)..(452): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagcttgggttttccttgttgcttatttacaaaaggtgtccagtgtgaggtgcaggttggtggagacgtgggaggaggcttgatccagccgtgggggtcctgagactctcctgtgcagtctcgtgggttcgtcagtggcgactacatgacgcgtcggggtacccgccaggcctcccgaaggggaacgggccgtgggaggtggatctctaactttattagtagttggtacggtacccactatactacacagcctccgtaggaaacggggccattcaccatctanaagaagacaattccaagaacactagttntaatcttacaaatagaaactaacctgagagaccgagaccgacgaccatgtatactgtggtgggtctaatttacgtccggacccggttcgggggacccgggtaaccgtcggtacctacccggtccctacccccgacccgtcccaaaccccgg

SEQ ID NO: 416361 - DNA, 570 bp, Homo sapiens
  misc_feature: GZ8MTXP02F3OCV.22.85.H08.1.454.CMB.2.raw
  modified_base (354)..(354): a, c, t, g, unknown or other
  modified_base (363)..(363): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggagggcctggagtggatctctacttattatagtggtcgtaccanatactacanagctccgtgaacgggccattcaccatctacagaagaacaattcccaaggaaccactattgtaatcttaacaaatagaaactaacctgaagagaccgaggacacggcagtagtattacgtgtggtgggctagtttacgtcgtaccccggtgggggacccgggaacccgtcggtaccacccgtccctacccccaccctccgaaacccgg

SEQ ID NO: 416362 - DNA, 543 bp, Homo sapiens
  misc_feature: GZ8MTXP02HR5RM.22.85.H08.1.454.CMB.2.raw
  modified_base (351)..(351): a, c, t, g, unknown or other
  modified_base (417)..(417): a, c, t, g, unknown or other
  modified_base (430)..(430): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtcctgagactctcctgtgcagtctctgggttcgtcaggtggcgactacatgagctgggtccgcaggctccgagggaagggcctggaggtggatctacacttatttataggtggtcgtaccanatactacacagctcgagaacggccatcaccatctcaagaagacaatcaagaacacattgtatctanaaatgaaattacngagagacgagacacggccatgtatactgtggtgggactagttacgtcgaccccgtgggggacccgggtaaccctcggtccacccggtccctacccccgaccctaccgaacccg

SEQ ID NO: 416363 - DNA, 594 bp, Homo sapiens
  misc_feature: GZ8MTXP02F0ZPG.22.85.H08.1.454.CMB.2.raw
  modified_base (348)..(348): a, c, t, g, unknown or other
  modified_base (355)..(355): a, c, t, g, unknown or other
  modified_base (364)..(364): a, c, t, g, unknown or other
  modified_base (380)..(380): a, c, t, g, unknown or other
  modified_base (385)..(385): a, c, t, g, unknown or other
  modified_base (405)..(405): a, c, t, g, unknown or other
tcagacatacgcgtcacgaccggtgctcgatttagtatcactcagtcgaggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgcaggctccgagggaagggcctggagtggatctctacttattatagtggtgtaccanatactanacagctcgngaaggccatcacatcnagaanacaattcagaacacaagttntaatcttaacaaatagaaactaacctagaacgacgaccgaaggaccacggaccagtagtattacgtaggtggtacgggggtctaagttttacgttccgtacccccgggtgggggtacccccggggtaaacccgtcggggtaccctaacccgggtcccttacccccgacccccttaccccgaaaccccgg

SEQ ID NO: 416364 - DNA, 549 bp, Homo sapiens
  misc_feature: GZ8MTXP02H2B1V.22.85.H08.1.454.CMB.2.raw
  modified_base (335)..(335): a, c, t, g, unknown or other
  modified_base (360)..(360): a, c, t, g, unknown or other
  modified_base (386)..(386): a, c, t, g, unknown or other
  modified_base (391)..(391): a, c, t, g, unknown or other
  modified_base (414)..(414): a, c, t, g, unknown or other
  modified_base (420)..(420): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttctcagtggtgactacatgagctgggtcccgcaggctccgagggaaggcctggagtggatctcacttatttanagtggtcgtaccacatactacacanctccgtgaagggccatcaccatctanagaanacactcgagacatatatatctanaaatanaaatacagagagacgagacacgactagtagtatacgtggtggtggtacttacgttacgtccgacccggtcgggggacccggtaaccgtcggtaccgtacccgtcccgtacccctaccctacccgaaccg

SEQ ID NO: 416365 - DNA, 714 bp, Homo sapiens
  misc_feature: GZ8MTXP02G9JS6.22.85.H08.1.454.CMB.2.raw
  modified_base (264)..(264): a, c, t, g, unknown or other
  modified_base (278)..(278): a, c, t, g, unknown or other
  modified_base (509)..(509): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagtcgttgggttttccttgttgcttatttacaaaaggtgtccagtgtgaggtgctaggttggtggagacgtgggaggaggcttgatccgaggccggtgggggtcctggagactctctgtgcngtctcgtggtctcngtggcgactacatgacgcgtcgggtccgccgacggccgtccggaaggggaacggccgtagggacggtggactctactactttaattagtaggttggtacgtaaccaatactaactacaacgaacgtccgtaccgtaggaaaccggccgtattaccaacctaattcaacaaagaaacgaacctaaacgttaccgaaacggaaactaacgtaattacgttaattaccttaaanaaattaacggtaaaacttaacgagaaagacggaaccgaaggaaccacggtacctaagtacgttaattaacggttcggtaggttcggggtaactttacgtttaaccggtcccggtaccccggggttacggggggtaacccccggtaacccggttcggaccccgtacccggtccccctacccccgtacccccgtacccgaaacccgg

SEQ ID NO: 416366 - DNA, 613 bp, Homo sapiens
  misc_feature: GZ8MTXP02HI6ER.22.85.H08.1.454.CMB.2.raw
  modified_base (386)..(386): a, c, t, g, unknown or other
  modified_base (426)..(426): a, c, t, g, unknown or other
  modified_base (431)..(431): a, c, t, g, unknown or other
  modified_base (458)..(458): a, c, t, g, unknown or other
  modified_base (474)..(474): a, c, t, g, unknown or other
tcagacatacgcgtcacgaccggtgctcgatttagtatcactcagtcggcgggggggagaggagcccagcactgggattccgaggtgtttccattcggtgatcagcactgaacacagaggactcaccatggtagttttggctgagcttgggttttccttgttgcttatttacaaaaggtgtccagtgtgaggtgctaggttggtggagacgtgggagggaggcttgactccgaggccggttcggggggtccctggacgactctcctgtgcagtctcgttgggttcgtcaggtcggcgtactacagtgagcgtcgggtcccgccgaggcctaccggaggggaacggcgtggagtggatctctactttattagtggtggtcgtaccanactactacacagcgtcgtagacgggctattcactatctanagaanacatacgagacactagttagatctaanaatacgaacttaacgngagacgaccggaaggacacggactagtacgtattacgtcggtggtcggtactacgtttacgtcggaccccggttgggggaccccggtaaccgttggaccccgtacccgtccctacccccgacctacccgaaaccccggg

SEQ ID NO: 416367 - DNA, 560 bp, Homo sapiens
  misc_feature: GZ8MTXP02I5Z7Q.22.85.H08.1.454.CMB.2.raw
  modified_base (398)..(398): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgaggggaagggcctggagtggatctcactttatttatagtggtcggtacccatatactacacagctccgtaggaaggccgattcaccatctcagaanacaattccagaacacattgatcttacaaatgaatactgagacgccgagacacggccatgtattacgtgtaggtggggctagtttacgtcgaaccccgtcgggggacccgggtaacccgtcgggtaccacccggtcctacccccgacccctcccaaaccccgg

SEQ ID NO: 416368 - DNA, 617 bp, Homo sapiens
  misc_feature: GZ8MTXP02JWFUM.22.85.H08.1.454.CMB.2.raw
  modified_base (364)..(364): a, c, t, g, unknown or other
  modified_base (372)..(372): a, c, t, g, unknown or other
  modified_base (454)..(454): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggttggtggagactggaggaggcttgatccagccgtgggggtccctgagactctcctgtgcagtctcgtgggttcgtcaggtggcgactacatgagcgtgggtccgccgaggcctccgaggggaggccgtggagtggatcgtctacttattagtagtggtcgtacacagtactancccagccncggtatggaccgagttcaccgacactctacgaacgaacgaacttaccacgacgaacacttagtattactactaaactagtanaaaaccttagacgaagccgagaacacggccacgtgtaagttacgttacgtaggttgggcgtacgttttacgaaaacgttcccccgtacgggggccccgggggtaaccggtcccgggtaccgtccccgggtacctacccccgacccgttccccccgaaaccccg

SEQ ID NO: 416369 - DNA, 563 bp, Homo sapiens
  misc_feature: GZ8MTXP02HSCPW.22.85.H08.1.454.CMB.2.raw
  modified_base (292)..(292): a, c, t, g, unknown or other
  modified_base (334)..(334): a, c, t, g, unknown or other
  modified_base (355)..(355): a, c, t, g, unknown or other
  modified_base (422)..(422): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttcgtcagtggcgactacatgagctgggtccncaggctccgaggaaggcctggagtggatcgtcacttatttanagtggtcgtaccacatactanacagctccgtagaacggccgtattcgactatctcagaagacaattccaaggaacactatgtatctanaaatgtaaataacctgagacgaccgagacacggccatacgtattactgtcgtgggactagtttaacgtcgtaccccgtgggggacccgggtaaccctcggggtaccacccggtacctcccccacccgtacccaaaccccgg

SEQ ID NO: 416370 - DNA, 547 bp, Homo sapiens
  misc_feature: GZ8MTXP02IB2EP.22.85.H08.1.454.CMB.2.raw
  modified_base (279)..(279): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttcgtcagtggcgactacntgagcgtgggtccgccaggctccgagggaacggccgtggagtggatctctactttatttatagtggtcgtaccagtatactacacagctccgtagaacggggccattcacactctacagaagacaaattaccaaggaacactaattgtactcttacaaatagaactaacgtgaagagaccgagacgacgacatagtatactgtgtgggctattactcgaccgtgggaccggaacctggaccaccgtcctccccgacctaccaacccgg

SEQ ID NO: 416371 - DNA, 687 bp, Homo sapiens
  misc_feature: GZ8MTXP02JGD6C.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggtccgcaggctccgagggaaggcctggagtggatcgtactactttaatttagtaaggttggtacggtaccaactactactacaacacgacgtccgtaggaacggggaccattccgaccatctacaaagaacgaacaaacttacccgaaaggaaccaactaacgtttagtacttacctttaaacaaaattacggtaaaacttaacccttaggaacggaacggacccggaaacgggaaccaaccgggaccaattacggttaaacttacggttaggttcggtgggggtactaacgttttaaccgtacggaacccccgggttcgggggaccccggggtaaacccgtcgggtacccccgtacccgttcccgtacccccgtaccccgttacccgaaaccccggg

SEQ ID NO: 416372 - DNA, 553 bp, Homo sapiens
  misc_feature: GZ8MTXP02GN02O.22.85.H08.1.454.CMB.2.raw
  modified_base (352)..(352): a, c, t, g, unknown or other
  modified_base (363)..(363): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaacgggcctggagtggatctcacttattatagtggtcgtaccanatactacacanctcgtggaaggccgattccacatctcagaagacaattccagaacactattgtatctacaaatagaataacctgagagaccgagacacggccatagtatacgtgtgtggggactagttactcgacccgtcggggcccggggtaacccgtcggtaccgtacccgtccctaccccacccgtacccgaacccgg

SEQ ID NO: 416373 - DNA, 674 bp, Homo sapiens
  misc_feature: GZ8MTXP02I9J28.22.85.H08.1.454.CMB.2.raw
  modified_base (292)..(292): a, c, t, g, unknown or other
  modified_base (335)..(335): a, c, t, g, unknown or other
  modified_base (349)..(349): a, c, t, g, unknown or other
tcagacatacgcgtcacgaccggtgctcgatttagtatcactcagtcgcggggggagaggagcccagcactgggattccgaggtgttcccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttctcagtggcgactacatgagcgtgggtccncaggctccgaggggaggcctggagtggatctctacttatttanagtggtcgtaccanatactacacagactccgtagaacgggccattcaccatctacaagaagaacaattaccgaaggaaccaactatttagtaactacttttaaccaaaattacggtaaaacttaaacccgtggaacgggaacgaccccggaagggaaccaacccggggacctaagtacggtttaattaaaccgtggtttcgggtagggggtacttaaacttttccggtttaccggaacccccggtttggggggaacccccgggggtaaaccgttcccggggtacctaaacccccgggttccccgtaaccccccgtacccccttacccgaaacccccggg

SEQ ID NO: 416374 - DNA, 683 bp, Homo sapiens
  misc_feature: GZ8MTXP02G8RWS.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgccaggcctccgagggggaacgggccgtggagtggatcgtactacttatttataggtggtcggtaccacatactacacagctccgtgaacgggccgattcaccatctcaagaagaacaacttacccgaagaaccactacttagtatacttacaaaatgaaaacttaaccgagtaaggaacgaccggaacggaacgaaccggaccaagttagtaactttaaccgttaggttgggtacgggggtaccttaaaggttttaacccgtttaccgggaaccccccggttacggggggacccccgggggtaaaacccccgttcgggggtaccccgtacccccgggttacccctaccccccccgtaacccccgttaccccgaaaaccccccgggg

SEQ ID NO: 416375 - DNA, 722 bp, Homo sapiens
  misc_feature: GZ8MTXP02HG0BR.22.85.H08.1.454.CMB.2.raw
  modified_base (515)..(515): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgtcagtggcgactacatgagcgtgggtcccgcgacggctcccgaaggggaacggggccgtgggaggtggaattccgtctaactttaatttagtaggttggtaccggtaacccaactactaactacacaagtaccttccggtaggaaacgggccgtaattccaacctacttcacaaagaaacgaactaaattcccgaaaggaaccaactagttgtaaacttctttaaacaaaagttagtaaaacttaaaccgngaacgggaacgccggaaacggaaaccgacccgggaaccaagttagttaaacgttaccgtgggtaccggtagggggtaccttaacgtttaaccgtttcggaacccccccggtgggggggtaacccccggggtaaaccccgtcggggtttaaccccccgtacccccgtacccccgttacccccccgaacccccgtaccccgaaccccgg

SEQ ID NO: 416376 - DNA, 642 bp, Homo sapiens
  misc_feature: GZ8MTXP02HCYO1.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagactggaggaggcttgatccagccgtgggggtccctgagactctcctgtgcagtctctggggttctcaggtggcgactacatgagcgtgggtcccgccaggcctccgaggggaagggcctgggagtggatctctacttatttagtagtggtcgtaccacatactacaacagacctccggtagacgggtaccgattaccgaccctatctacaaacgaagtaaccaaattacccgaaggaaaccactaatttataactaccttaacgaaaattgaaactaaacccgtgaacgaacgccggagaacaccggactatcgtattaacgtgtaggtggggtaccttaagttactttaccggaacccccggtgggggaaccccgggggtaaccccgttggggtacccctaacccggtccctacccccctaaccccgtcccaaaccccggg

SEQ ID NO: 416377 - DNA, 415 bp, Homo sapiens
  misc_feature: GZ8MTXP02FNASP.22.85.H08.1.454.CMB.2.raw
  modified_base (410)..(415): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaataacctgagagccgaggacacggccatgtattactgtgtggggcatttacttgacccctgggccgggaaccctggtcaccgtctccccaccctccaccaaggcccatcggtcttccccctggcaccctcctccaagagcacctctggggcacagcggccctgggctgcctggtccaaggactacttccacgcgtatgtctgagcgggctggcaaggcgcatagnnnnnn

SEQ ID NO: 416378 - DNA, 660 bp, Homo sapiens
  misc_feature: GZ8MTXP02G3H1T.22.85.H08.1.454.CMB.2.raw
  modified_base (355)..(355): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaacggcctggacgtggatctctacttatttatagtggtcgtaccanactactacacagctcgtagaacgggcctattcacatcacagaaagacaacttcccgaaggaaccacgaatttagtacttacctttaacaaaattagtaaaacttaacccgtagaacggaacgacccggaaggaacccgacgggaccctagttacggttaacttacgttaggtcggttagggggacttaacgttttaccgttccgggtaacccccggttgggggtaacccccgggggtaacccgttcgggttacccgaccccggtttacccctacccccccgtaaccccgtacccgaaacccccgg

SEQ ID NO: 416379 - DNA, 607 bp, Homo sapiens
  misc_feature: GZ8MTXP02J2O34.22.85.H08.1.454.CMB.2.raw
  modified_base (362)..(362): a, c, t, g, unknown or other
  modified_base (377)..(377): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtccctgagactctcctgtgctagtctcgtgggttcgtcaggtggcgactacatgagcgtcgggtccgcgaggcctcgaggggaacggccgtggagtggatctcactttattataggtggtaccgtaccanactactacacagccncgtagacggcattccacatcctacaagaacgaactaactcccagaaccactattacgtatctaacaaatacgaatacctgacgagccgaggacacggcagttgtaatacgtggtggtcgggacttagttttaccggccggtaacccccggttgggggaacccccgggtaacccgttcggtaccccgtacccggttaccccaccccccgtacccgtcccgaaacccccggg

SEQ ID NO: 416380 - DNA, 567 bp, Homo sapiens
  misc_feature: GZ8MTXP02FPGPQ.22.85.H08.1.454.CMB.2.raw
  modified_base (358)..(358): a, c, t, g, unknown or other
  modified_base (397)..(397): a, c, t, g, unknown or other
  modified_base (402)..(402): a, c, t, g, unknown or other
  modified_base (420)..(420): a, c, t, g, unknown or other
  modified_base (427)..(427): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggacgggcctggagtggatcgtctactttattataggtggtacgtaccanatactacacacgctccgtagaagggccattcaccatcanagaanacaatccaagacactatntatctanaaatagaactaactgagacgaccgagacacgacagtagtattacgtgtggtgggtctaagtttactccggacccggtgggggaccccgggtaaccgtcggtacccaccggttcccctacccccgaccctacccaacccgg

SEQ ID NO: 416381 - DNA, 572 bp, Homo sapiens
  misc_feature: GZ8MTXP02FN3X0.22.85.H08.1.454.CMB.2.raw
  modified_base (346)..(346): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccgagggaagggcctggagtggatctcacttattatagtgtgtaccanatactacacagctccgtgaaggccattcaccatctcagaagacaattccaggacacgattgtatcttacaaatgaataacctgaagagaccgaaggacacggccatagtattacgtgtaggtgggggtactagtttacgttcgtacccccgtcgggggtaccccggggaaacccgtcgggtaccctaacccggttccctacccccgacccgtaccccaaaccccgg

SEQ ID NO: 416382 - DNA, 610 bp, Homo sapiens
  misc_feature: GZ8MTXP02IWQAP.22.85.H08.1.454.CMB.2.raw
  modified_base (518)..(518): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtccctgagctctcctgtgcagtctcgtgggttcgtcagtggtagactacatgagcgtcgggtccgcgaggctccgaggggaacgggccgtggaggtggatctactacttattagtagtggtcgtaccatactactacacagctcggtagacggaccgattacacctatcctacgaagaacgaactaacttaccgaacggaaccactaatttagtactacttaaactaaatacgtaaacttaaccagaagacgaccgacggacacggactatagtattacgtggtggngggtactacgtttacgtccgtacccggtacgggggacccgggtaaccgtcgtaccgtacccgtccctaccccctacccgaccgtaaccccgg

SEQ ID NO: 416383 - DNA, 682 bp, Homo sapiens
  misc_feature: GZ8MTXP02GG8XY.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccagccgtgggggtccctgagactctcctgtgcagtctcgtgggttcgtcaggtggcgactacatggacgcgtcgggtcccgcgacggccgtacggaggggacgggcgtaggagtggactcgtctactttatttagtaggtggtccgtaccactatactacacacgtccgtccgtaggaacggggtaccgtacttaccgaacctatcctacaaaggaaacactaacttaccgaaagtaacctactattacgtacttacctaaactaaattagtaaaactaaccgtaggaacgtacgaacccggaggaaccgacggacctaagtaggttacttagtggttacgggtgggtactttaacgtttaccgtccgggtaacccccggggtcgggggaaccccggggtaacccgttcgggacccctaccccggttcccctacccccgaccccgtacccgaaacccccggg

SEQ ID NO: 416384 - DNA, 587 bp, Homo sapiens
  misc_feature: GZ8MTXP02H8DAF.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaacgggcctggagtggatctcactttatttatagtggtcggtaccacatactacacagctcgtagacgggccattcacatctacagaagaacaattccaaggaacactatgtatctacaaatagaataactgagagaccgagacgacggcagtagtattacgtgtggtgggtactagtttaccgttcggaccccggttcgggggaccccggggtaaaccccgttcggtacccgtaccccggttccctacccccccgacccgttaccccgaaaccccggg

SEQ ID NO: 416385 - DNA, 542 bp, Homo sapiens
  misc_feature: GZ8MTXP02G2U0H.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactggaggaggcttgatccagcctgggggtccctgagactctcctgtgcagtctctgggttctcagtggcgactacatgagctgggtccgccaggctccgagggaaggcctggagtggatctcacttattatagtggtggtaccccacatacgtacacagactccgtgaaggccgattcacatctcagaagacaattccaagaacacattgtatcttacaaatgaaatacctgagagaccgagacacggcatcgtatactgtgtgggctacttacgtacgcccgtacggggccgggtaacctcggtccaccggtcctccccgaccctcccgaccgaacccgg

SEQ ID NO: 416386 - DNA, 635 bp, Homo sapiens
  misc_feature: GZ8MTXP02GTE6L.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtcccgccgaggcctccgaggggaacggccgtaggagtggatctctacttatttataggtgtacgtaccacatactacacagcgtccgtagaacgggccgtattcacctatctacaagtaagacaattacccgaaggaaaccactaagttgtaacttcttaaacaaattaacgaaacttaaccgtagaacggacgacccggaaggaaccacgggacctagtagtattacgtagtgggtacggggtactacgtttaccgtcggaccccggttcgggggacccgggtaacccgtcggtacccgtaccccggtccctacccccgaccccgttacccgaaaccccggg

SEQ ID NO: 416387 - DNA, 781 bp, Homo sapiens
  misc_feature: GZ8MTXP02F07OC.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccggtgggggtccctgacgactctcctgtgctagttctcgttggttcgtcgagtggcgactacagtgacgcgtcgggcccgcgacggcctaccggaaggggaacgggtcccgtaggggtaggttacggtaacttccgttaccttaaacgtttttaagtttaaggtttaagggtttcggggttacccgggttaaaccccaaacgtaaacttaaaccttaaaccgaaccgtaacggtaccgttacccgggtaaggggaaaacccggggtccctaacgtttacccaaaccctagttacccgtaacgaaaggtaaaacccgtaaacttaaacgtttaacccgaaacggtaaacctaacgttaatttagttaaactacctttaaacaaaagttactaaaactaaccgtaggaagacgaccggagaccgacgactagtagtattacgtggtacggtaggtacttacgtttaccggtccggaaccccggtgggggaacccccggtaaccgttcggtaccccgtacccgtcccgtaccccccgtacccgtacccgaaaccccgg

SEQ ID NO: 416388 - DNA, 665 bp, Homo sapiens
  misc_feature: GZ8MTXP02G1LWC.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtacagtctcgtgggttcgtcgaggtggcgactacagtgagctggggtcccgccgaggctaccgaggggaacggccgtggacgtggatctctactttattagtaggtggttacgacccacatactacacacgactccgtaggaacggccgtattccgaccatcctacagtaaagactaactacaacggaacactatttacgtaacttacttaactaaaagtacgtaaaactaaccgttaggaacgaacggacccggaacggaaccgaacggaccgtaagttacgttaatttacgtggtttcggtcgggggtacttacgtttaccgttacggtaccccggtacgggggacccgggtaacccgtcggtacccgtacccgtacccgtaccccctacccgtaccccgacggtaaccccggg

SEQ ID NO: 416389 - DNA, 607 bp, Homo sapiens
  misc_feature: GZ8MTXP02IF4ES.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctaccgaggggacggcctggacgtggatctctacttatttatagtggtcgtaccacatactacacagactccgtaggaacgggccgattccaccatctacaagaaacgacaattcccaaaggacactattgtattcttaacaaatgaaactaactgagacgccgaggaccacggaccatagttattacgtggtgtggggtacttacgtacgtttaccgacccgggtacccgggggtacggggtaacccggtaacccggttccgaccgtacccccgtacccccgacccccgaacccgtaaccccgg

SEQ ID NO: 416390 - DNA, 725 bp, Homo sapiens
  misc_feature: GZ8MTXP02HE37X.22.85.H08.1.454.CMB.2.raw
  modified_base (296)..(296): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgacgactctcctgtgcagtctcgtgggttctcgagtggcgactacatgagcgtgggtcccncgaggctccgaggggacggcctggagtggatctctacttaatttagtaggtggtcggtaacccactaatacctacacgagtaccgtccggtaggaaacgggccgtaattccacctaaacgttcctacaacggtaaacgaacctaaacgtttcccgaaaaggtaaaccaaccgttaattttacgggtaaacttacccgtttaaaacgtaaaacgttacgtaaaacgttaccgtaggaaacggtaaccggaccggaacggaaccgtaccggtaactaagtttacgtacttaacggttcgggttacggggttacggttacgttaaacgttttacccggaccggtacccccggggttcgggggtaacccccgggtaaccgttcggtacccgtaaccccggtcccctacccccgacccgtacccgtaaccccgg

SEQ ID NO: 416391 - DNA, 599 bp, Homo sapiens
  misc_feature: GZ8MTXP02I4U06.22.85.H08.1.454.CMB.2.raw
  modified_base (410)..(410): a, c, t, g, unknown or other
  modified_base (438)..(438): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactgggaggaggcttgatccagccgtgggggtccctgagactctcctgtgcagtctcgtgggttcgtcaggtggcgactacatgagcgtgggtccgccgaggcctcgaggggaaggcctaggagtggatcgtctactttattatagtggtcggtacccacataactacacacgactccggtagacggggccattccacatctacagaanacaatccaagaacactattgtatcttanaaatagaaataactagagagaccgacgacgacggcagtgtactacgtggtggtcggggtattacgtttacgtaccggtacccggtcgggggaccccgggtaaaccgtcgggtaccctacccgtcccgtaccccgtaccccgtaccgaacccggtaacccgg

SEQ ID NO: 416392 - DNA, 622 bp, Homo sapiens
  misc_feature: GZ8MTXP02FO1IG.22.85.H08.1.454.CMB.2.raw
  modified_base (362)..(362): a, c, t, g, unknown or other
  modified_base (406)..(406): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagttctcgtggggttcgtcaggtggcgactacgatgagcgtgggtccgccgaggctccgaggggaagggcctggagtggatctatactttatttataggtggtcgtaccanatactacacagcctcgagaagggcctattccacatctacagaanacaatccgagaacactattgtatcttacaaatagaaactaaccgtagaggacgaccggacgacgacggacacgttgtacttacgtggtaggtcggggtacttacgtttaccgttaccggtacccccgggtcgggggtaccccggggtaaccccgttcggggttacccctaccccggttccctaccccccgtaaccccgtccccgaaaacccccggg

SEQ ID NO: 416393 - DNA, 575 bp, Homo sapiens
  misc_feature: GZ8MTXP02JG39G.22.85.H08.1.454.CMB.2.raw
  modified_base (294)..(294): a, c, t, g, unknown or other
  modified_base (355)..(355): a, c, t, g, unknown or other
  modified_base (420)..(420): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgcaggtggcgactacatgagctgggtccncaggctccgaggggaaggccgtggagtggatcgtcactttatttatagtggtcggtaccanatactacacagctccgtgaacgggccgattcacatctcaagaagacaattcgaaagacactattntactcttaacaaatgaaattaccagagaacgaccggaggacacggccagtgtaatacgtgtagtcggggactagtttacttccggaaccccgtgggggaccccggtaaccgtggtaccctacccggtccacccccggtaccctccgaaaccccgg

SEQ ID NO: 416394 - DNA, 669 bp, Homo sapiens
  misc_feature: GZ8MTXP02IA2IX.22.85.H08.1.454.CMB.2.raw
  modified_base (252)..(252): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagccgtgggggtccctgagactctcctgtgcngtctcgtgggttcgtcagtggcgactacatgagcgtgggtcccgccgaggctccgaggggaacgggccgtggagtggatcgtacactttatttagtagtggtacggtaccaacgtatacctaacacaacgtactcccggtagaacgggtccgtaagttaccacctatccctacaagaaacgacaaacttcccgaaggaaaccactattagttaactcttaacaaattacgaaaacttaaccgtgaaggacgaccgaaggacgacggacctatgttaagttacgttaggtggttaggggacctttagtttaccgttacggtacccccggttcgggggtaacccccgggggtaaccccgttcggggtaccctacccggttccccgtaccccccgtaaccccgtaccccgaaaccccggg

SEQ ID NO: 416395 - DNA, 760 bp, Homo sapiens
  misc_feature: GZ8MTXP02J07F3.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcgaggctccgaggggaaggccgtggagtggatctctactttatttatggtggtcgtaccatataactacacacgtcctccggtaggaacgggccgtattaccaaccgatcctacgaagaaacgaactaaacgttcccgaaggaaaccactaatttcggttaaacttccttaaactaaaacttagtaaaaccttaaaccgttagggaacggaacggacccggaacggggaacccgaacccggggtaccctaaggttacgttaaactttaacccggttagggttcggggttacgggggtacctttaaaccggttttacccggtttacccgggaccccccgggggtttacccggggggggtaacccccgggggttaaccccggttacccgggggttacccccgttaaccccccggttcccccgttacccccccgtacccccccgttaccccgtaaaacccccccgggg

SEQ ID NO: 416396 - DNA, 639 bp, Homo sapiens
  misc_feature: GZ8MTXP02JVIWQ.22.85.H08.1.454.CMB.2.raw
  modified_base (301)..(301): a, c, t, g, unknown or other
  modified_base (468)..(468): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttacaaaggtgtccagtgtgaggtgcagttggtggagactggaggaggcttgatccagccgtgggggtccctgagactctccgtgtgcagtctcgtgggttcgtcgaggtggcgactacagtgagtcgtgggtcccncgaggctccgaggggacggccgtggagtggatcgtctactttatttataggtggtcgtaccatatactacacagtcctccgtaggaacggcctagttccaacctatacctacgaaagaaacgaactaaacttcccgaaaggaaccacgtaattgtacttccttaaanaaatagaaacttaaccgagaacgacgaccggaaggaccgaacggcctaagtacgtacgtagttcggtaggtagggtacttagtttaccggtccgtacccccggtacgggggaccccggtaaccgtcggtaccccgaccgtcccctacccccgacccctaccgaaaccccgg

SEQ ID NO: 416397 - DNA, 586 bp, Homo sapiens
  misc_feature: GZ8MTXP02GFBVQ.22.85.H08.1.454.CMB.2.raw
  modified_base (293)..(293): a, c, t, g, unknown or other
  modified_base (390)..(390): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccnccgaggcctccgagggaaggcctggagtggatcgtctactttattatagtggtacgtaccatatactacacagctccgaggaacggccgattcaccntctcagagacaattccagaacacattgtatcttacaaatagaaataaccgtagagacgaccgaggacacggccatagtattacgtggtaggtggggactagtttaccgtacggacccccggttgggggaccccggggaaacccgttcggtacccgtaccccgtcccgtaccccccaccccgttcccgaaaccccgg

SEQ ID NO: 416398 - DNA, 632 bp, Homo sapiens
  misc_feature: GZ8MTXP02GYMPB.22.85.H08.1.454.CMB.2.raw
  modified_base (389)..(389): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgacgactctcctgtgctagtctcgtgggttcgtcgagtcggacgtactacagtgacgtcgtcgggtcccgccgaggcgtccgagggaacggccgtagggagtggactctctactttaatttacgtaggttggtaccgtaccacgatactacacancgtcgtagacgcctatcactatccatagaacacgataccgaagtaaccatacgttatactacttaaacaatagaaactaaccgtagaacggtacgaccgaaggtacacgggtactagtacgtaattcgtagtacgggtggtccttaaacgtttcggtaccgtacccggggtcgggggtaccccgggtaaccgttcgggaccctaccccggtccctacccccaaccggtacccgaaaacccggg

SEQ ID NO: 416399 - DNA, 440 bp, Homo sapiens
  misc_feature: GZ8MTXP02HIQ1I.22.85.H08.1.454.CMB.2.raw
  modified_base (314)..(314): a, c, t, g, unknown or other
  modified_base (347)..(347): a, c, t, g, unknown or other
  modified_base (389)..(389): a, c, t, g, unknown or other
  modified_base (424)..(440): a, c, t, g, unknown or other
tcagacatacgcgtcacgaccggtgctcgatttagtatcactcagtcgcgggcaggctccagggaagggcctggagtggatctcacttatttatagtgggtggtaccacatactacacagactccgtgaagggccgattcaccatctcagaagacaattccaggaacacattgtatcttcaaatgaaataacctgagagccgaggacacggcatgtattactgtgtgggctatttactcgaccccgtggggcccggggaacctggtccaccgtctccccaccctccaccaacggcccatctcgtccttcccccngccaccctcctcaagcgccactcgtggggcacncggcgcccgtggctgcctcggtacacgactactcacgtcgtncgtactggacggcgggctgggacaaggcgcatagnnnnnnnnnnnnnnnnn

SEQ ID NO: 416400 - DNA, 606 bp, Homo sapiens
  misc_feature: GZ8MTXP02IF115.22.85.H08.1.454.CMB.2.raw
  modified_base (295)..(295): a, c, t, g, unknown or other
  modified_base (445)..(445): a, c, t, g, unknown or other
  modified_base (471)..(471): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagctgggtccncaggctccgagggacggcctggagtggatctctacttatttataggtggtacgtaccactagtaacctactacaagccttccggtaggaacggggccctaagtttccaacctagtctacgaagaaagacaattccaaggaacactagttntatacttacaaattgaaattaaccgngagagccgaaggacacggctatgtacttacgtggtggtcgggacttaacgtttcgtccggaccccggtgggggacccgggtaacccgtcgggtaccctacccggtccctcccccgaacccgttccgaaaccccgg

SEQ ID NO: 416401 - DNA, 550 bp, Homo sapiens
  misc_feature: GZ8MTXP02H62R0.22.85.H08.1.454.CMB.2.raw
  modified_base (397)..(397): a, c, t, g, unknown or other
  modified_base (429)..(429): a, c, t, g, unknown or other
  modified_base (530)..(530): a, c, t, g, unknown or other
tcagacatacgcgtcacgaccggtgctcgatttagtatcactcagtcgcggggggagaggagcccagcactgggattccgaggtcgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtcccgccaggctcccgaggggaagggccctggagtggatcgtcactttatttatagtggtcgtaccacatactacacagctccgtgaaggggccattcaccatctnagaagacaattccagaacacattgtatcttanaaatagaataacctgagagccgaggacacggcatgtatctagtggtgggctattacgtcgaccccggtggggacccgggaacctcggtaccacccggtccnccccctacctccaaccccgg

SEQ ID NO: 416402 - DNA, 744 bp, Homo sapiens
  misc_feature: GZ8MTXP02I37QH.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgctaggttggtggagactgggaggaggcttgatccaggccgtgggggtccctgacgactctcctgtgctagtctcgtgggttcgtcgaggtcggcgactacagtgacgtcgtcggggtcccgccgacggcctacccggaaggggaacgggccgtaggggaaggtggaacttccttacttaaccttttaagtttacgtaaggttcgggttacccgtaaccctaacgtacttaaccgtacaaccgtacgtaccgtccggtaagggaaaccgggggtaccctactttacccgaacctacttacctacgaaacgaacgtaaacctaaacgtttacccgaaaggtaaaccaacgttatttacgtaaacttactttaaacaaacgtttagaaacttaaccgtaggaaggtaccggaccgaaggtaccgaccggtaccagttagttacttacgtcggtggtacgggtcttaacgttaccggttacgtaacccccggggtcgggggacccgggttaacccgtcggtccctacgtcccgtacccctaccccgtaccccttacccg

SEQ ID NO: 416403 - DNA, 617 bp, Homo sapiens
  misc_feature: GZ8MTXP02I6R2P.22.85.H08.1.454.CMB.2.raw
  modified_base (462)..(462): a, c, t, g, unknown or other
  modified_base (477)..(477): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccgtggggggtcctgagactctcctgtgcagtctcgtgggttcgtcaggtggcgactacagtgagcgtcggggtcccgccgacggctccggaggggaacggggccgtggggacgtggacttcctctaactttatttagtagtggtaccggtaccactatactacacgagcgtccgtaggacggccgtattcacctatcctagaagaacgactaatccgaaagacactattgacttctaanaaatgaaattaccgngagacgccgaggaaccacggctagtgtattacgtggtacggtgggtacctagtttacggtccggaccccggtgggggaaccccggggtaaccctcggggtacccacccggttccctaccccccaccgttacccaaaccgg

SEQ ID NO: 416404 - DNA, 545 bp, Homo sapiens
  misc_feature: GZ8MTXP02JMIC6.22.85.H08.1.454.CMB.2.raw
  modified_base (250)..(250): a, c, t, g, unknown or other
  modified_base (355)..(355): a, c, t, g, unknown or other
  modified_base (389)..(389): a, c, t, g, unknown or other
  modified_base (412)..(412): a, c, t, g, unknown or other
  modified_base (422)..(422): a, c, t, g, unknown or other
  modified_base (427)..(427): a, c, t, g, unknown or other
  modified_base (433)..(433): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtncagtctcgtgggttctcagtggcgactacatgagctgggtccgccaggcctccgaggggaacgggcctggagtggatctctacttatttagagtggtcgtaccanatactacacagctcgtagacgggccatcacatcncagagacattccaagacactatntatcttaaanaatanaatacngagacgacgagacacgcagtatatagtgtaggtcggactagttacgtccgacccggtcggggacccggtaacgtcggtaccctacccgtccctaccccaccgtacccgaccg

SEQ ID NO: 416405 - DNA, 561 bp, Homo sapiens
  misc_feature: GZ8MTXP02JUT79.22.85.H08.1.454.CMB.2.raw
  modified_base (292)..(292): a, c, t, g, unknown or other
  modified_base (324)..(324): a, c, t, g, unknown or other
  modified_base (333)..(333): a, c, t, g, unknown or other
  modified_base (346)..(346): a, c, t, g, unknown or other
  modified_base (354)..(354): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagctgggtccncgaggctccgagggaggcctggagtggatctnacttattanagtgtcgtaccanatacacanacgctccgtgaacggccattcacatctcagaagacaattcccagtaacacattgtatcttaacaaatagaactaaacctgagagccggaaggacacggccatgtaattacgtgtaggtgggcctagttttaccgtcgtaccccgtgggggaccccgggaacctggggtacccacccggttaccacccccgtacccgtacaaccccgg

SEQ ID NO: 416406 - DNA, 630 bp, Homo sapiens
  misc_feature: GZ8MTXP02JZHDP.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttggatccagccgtgggggtccctgagactctcctgtgcagtctcgtgggttctcagtggcgactacatgagcgtgggtcccgccgaggcctccggaggggaacgggccgtagggagtggactccgtactactttatttagtaggtggtaccggtaccagtactactacacacgctccggaggaacggggcctattccgacctatcctacaagaacgaacaacttcccgaaggaaacacctaatttcgtacttcttaacaaatagaaactaaccgtgaacggacgaccgaaggaccacggactagtagtacttacgtggtaggtcggggacttacgttaccgtccgaccccggtgggggaccccgggtaaccgtcggtccccacccgtccctacccccgaccctaccgaaccccgg

SEQ ID NO: 416407 - DNA, 570 bp, Homo sapiens
  misc_feature: GZ8MTXP02I2QB7.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggagggcctggagtggatctcacttattatagtggtcgtaccacatactacacagactccgtagaacgggccgtattcaccatctcaagaagacaaattccaaggaacacattgtatacttacaaatgaaattaacctgaagacgaccgaggacacggcatagtattactagtggtgggtctatttacgttcggacccccgttgggggacccggggtaaccgtcggtaccacccggtccctcccccgacccttacccgaacccgg

SEQ ID NO: 416408 - DNA, 618 bp, Homo sapiens
  misc_feature: GZ8MTXP02JJ1VY.22.85.H08.1.454.CMB.2.raw
  modified_base (398)..(398): a, c, t, g, unknown or other
  modified_base (401)..(401): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgtgggttcgtcaggtggcgactacagtgagcgtgggtcccgccgaggctccggaggggaaggccgtggagtggatctctactttattagtagtggtccgtaccatatactacacacgctccgtaggaacggccgatcacntcnagacgacaacttcaagaacactattagtatacttaacgaaatagaaactaccgtagagacgacgaggaccacggaccagttagttaagttacgtaggtggttacggggtacttacggtttaccttcgggacccccggtcgggggaccccgggtaaacccgttcgggtaccccgtaccccgttccccgacccccgtaccccgacccgtaaaccccggg

SEQ ID NO: 416409 - DNA, 640 bp, Homo sapiens
  misc_feature: GZ8MTXP02G13BN.22.85.H08.1.454.CMB.2.raw
  modified_base (425)..(425): a, c, t, g, unknown or other
  modified_base (485)..(485): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgctagtctcgtgggttcgtcgaggtggcgactacatgagcgtcgggtccgccgaggccgtaccgaggggaacggccgtggaggtggacttctactactttatttagtaggtggtaccgtaccatactacacacgagcctccgaggacggacctattcactactctagaaagaaanactaataccgaaagaacctactattacgtacttacttaaacaaatagtaaaacttaccgngaaacggacgacccgtaaggacccacggctaagtagtaactacgtggttagggtgggtactacgtttaccggccggacccgtcgggggacccggtaacccttcgggtacccctaacccggtcccctaacccccgttacccaccgtaaacccccgg

SEQ ID NO: 416410 - DNA, 572 bp, Homo sapiens
  misc_feature: GZ8MTXP02HPZX8.22.85.H08.1.454.CMB.2.raw
  modified_base (172)..(172): a, c, t, g, unknown or other
  modified_base (249)..(249): a, c, t, g, unknown or other
  modified_base (262)..(262): a, c, t, g, unknown or other
  modified_base (266)..(266): a, c, t, g, unknown or other
  modified_base (268)..(272): a, c, t, g, unknown or other
  modified_base (274)..(274): a, c, t, g, unknown or other
  modified_base (284)..(284): a, c, t, g, unknown or other
  modified_base (296)..(296): a, c, t, g, unknown or other
  modified_base (300)..(300): a, c, t, g, unknown or other
  modified_base (302)..(302): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtggtttcgtgtaggctattacaaaggtntcagtgtgaggtgcagttggtggagacgtggaggaggcttgatccagccgtgggggtccctgacgctctctgtgacngtctgtgggtctnaggngnnnnngngcgcgcgcgngcgcgaggaggngtgngngatctctattattagtagtgtacgtactactatactacacacgcgtacgtacgacggacgtactacactactactacgaagaacgaactaactaacgaacgaacaactatagtactactaataataataactaacgtagagacgacgacgacgacgtactagtagtagttagtacggtaggtaggtacgttacgttacgtaccgtaccggtaccgggtaccggtaaccggtcgtaccgtaccgtacccgtacccgtaccgtaccgtaccg

SEQ ID NO: 416411 - DNA, 593 bp, Homo sapiens
  misc_feature: GZ8MTXP02GV3PL.22.85.H08.1.454.CMB.2.raw
  modified_base (366)..(366): a, c, t, g, unknown or other
  modified_base (383)..(383): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcggggtccgccgaggcctaccgaggggaacgggcctgggagtggatcgtactactttatttataggtggtcgtaccanatactacacagctccgngaacgggccgattcatcatctacagaagacaacttacaagaactacattagtactacttacaaatagtaactactagagacgacggagacgacggccagtagtacttactggtcggtgggtactacgtttacgttccggtaccccggtcggggtaacccggggtaacccgtcggtaccgacccgtacccgtacccccgacccgtaccccg

SEQ ID NO: 416412 - DNA, 703 bp, Homo sapiens
  misc_feature: GZ8MTXP02GRBIT.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcaggtggcgactacatgagcgtcgggtcccgccgaggctccgaggggaagggccgtggagttgggactcgtactactttatttataggttggtcggtaccacgatactacacacgacctccgtaggaaaggggccgtattccaccatactaccgaaagaacgaactaaacgttacccaaggtaaaccaacgtaattcgtaacttaccttataaaattagaaaacttaaacctaggaacggaacgaccggaaacgggaaccgaaccgggacctaagttagttaacgtttaacgtacgggttacgggttagggggtaccttaaacgtttaccggttaccggtaacccccgggtcggggggtaccccgggggtaaaccccgtcggtacccgtaacccgggtcccctacccccgtaaccccttaccccgaaaccccggg

SEQ ID NO: 416413 - DNA, 573 bp, Homo sapiens
  misc_feature: GZ8MTXP02JYFBV.22.85.H08.1.454.CMB.2.raw
  modified_base (363)..(363): a, c, t, g, unknown or other
  modified_base (381)..(381): a, c, t, g, unknown or other
  modified_base (473)..(473): a, c, t, g, unknown or other
  modified_base (491)..(491): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtggggtgcagttggtggagactgggaggaggcttgatccaggccgtggggggtccctggagactctcctgtgcagtctcgtgggttcgtcagtggcgactacatgagctgggtccgccaggcctccgaggggaacggcctggagtggatctcgtactttattagtagtggtggtaccccanatactacacagactccgngaacgggccgattcacatctcagaagacaattccaagaacacattgtatcttacaaatgaatacagagacgcgagacacggcatgtatacgngtgtgggctagtttaccncgtaccccgtgggggaccccggggtacctcggggtaccctacccgtcccttacccccgaccccgtaccgacccgaacccggg

SEQ ID NO: 416414 - DNA, 543 bp, Homo sapiens
  misc_feature: GZ8MTXP02FIMP4.22.85.H08.1.454.CMB.2.raw
  modified_base (469)..(469): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccgagggaaggcctggagtggatctcactttattatagtggtcgtaccacatactacacagctccgtgaagggccgattcaccatctcagaaagacaattcccaggaacacaattgtatcttacaaatgaaataacctgaagagacccgaaggcaacgcatgtattactgnggtgggctatttactcgaccccgtgggggacccgggaacccgtggcccaccgtcctccccgaccctccaacccg

SEQ ID NO: 416415 - DNA, 623 bp, Homo sapiens
  misc_feature: GZ8MTXP02G3K9V.22.85.H08.1.454.CMB.2.raw
  modified_base (415)..(415): a, c, t, g, unknown or other
  modified_base (420)..(420): a, c, t, g, unknown or other
  modified_base (466)..(466): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttggatccagccgtggggggtccctgagactctcctgtgcagtctctgggttcgtcagtggcgactacatgacgcgtgggtcccgccgaggcctccggaggggaacgggccgtgggaaggtggactctctactttaatttagtaggtggtacgtaccacataactacacacgctcgtagaacgggccattcaccatctanagaanacaataccaggaaccacattgtactcttaacaaatcgaaactaacngaagacgaccgaaggacaccggacctagttacgtaattacgtggtacgggtaggggtacttaacgtttaccgttaccggacccccggttcgggggaccccggggtaacctcgggtaccctaccggtcccctacccccaccccgtaccgaaaccccgg

SEQ ID NO: 416416 - DNA, 665 bp, Homo sapiens
  misc_feature: GZ8MTXP02JVSCB.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccaggccgtgggggtcctgagactctcctgtgctagtctcgtggggttctcgagtggcgactacagtgagcgtcgggtcccgcgacggccgtccggaaggggaacgggccgtaggaggtggacttctactactttagtttagtaggtggtaccgtaacccatactaactacacgacgccgtccggtaggaacgggcctattaccgacctactctaacgaagtaaacgactaactacccgaaggaaaccactaattagtacttacttaaacaaatagtaaacttaaccgaggaacgacgaccggaaggaccgaacggctaagttagttaagttacgtggtacgggtagggtacttacggtttaccgttcggaaccccgggtcgggggacccggtaaccgtcggtaccctacccggtccctacccccgtacccgaccgaaaccccgg

SEQ ID NO: 416417 - DNA, 658 bp, Homo sapiens
  misc_feature: GZ8MTXP02JKBB7.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcgagtggcgactacatgagcgtcgggtccgccgaggcctaccgaggggaaggccgtggagtggatcgtctactttattagtaggtggtacggttaccacactactacacacgcgtccgtaggaaacgggccgtattccaccatacctcgaaagtaacgaactaacttacccgaagaaccactagttagtaactcctttaagaaaactggtaaacttaaccgtagaaggacgccgaaaggaccaacggtaccagttacgtaaagtttaccgtggttacggtacggggtacttaacggttttaccgtcggaacccccggttggggggaaccccggtaacccgtcgggtaccccgtacccgtcccgtacccccctaacccgtaccgaaaccccgg

SEQ ID NO: 416418 - DNA, 749 bp, Homo sapiens
  misc_feature: GZ8MTXP02G2SRW.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggtcttgactccgacggtccgggtcgggggtccctggacgtacctctccgtgtcgctagtctcggttcgggttcgtcgaggtcggaccgaactactagtaggacgtcggtcgggtccccgcgacggtccgtaccggaaggggaacggtccggtagggacggtggtactccgtactaacgtttaatttagtagggttggtacccggtaaccaacgtaactaacctaacaacgtaacgtaccgtccggtaacgggaaccggggtacctacgttacccaacctacttaccgtaacgaaaggaaacgtaacctaaacgttacccgaaaggtaaaccaacgttaagtttacgtacttacctttaaacgaaagttaaacggaaacttaaccgtaggaacggacgaccggaacggaaccgacggtacctagttacgttaactcgtaggtcggtgggtacttacgttacgtaccggacccggtcgggggacccggtaaccgtcggtacccgtacccgtaccctacccccgacccgtccgaaacccgg

SEQ ID NO: 416419 - DNA, 700 bp, Homo sapiens
  misc_feature: GZ8MTXP02IRM2X.22.85.H08.1.454.CMB.2.raw
  modified_base (418)..(418): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtcctgagactctcctgtgcagtctcgtgggttcgtcagtggcgactacatgagcgtgggtccgccgaggcctccgaggggaacggccgtggaggtggatctactacttatttagtagttggtacgtaccatactaactacacaagcctcgtaggaacgggccgattcaccgtatcgacaagaanactaaacttacccaaggaaacctaactaatttacgtacttacttaaactaaattagaaaacgttaaacctaggaacggtaagacccggaaggaacccgaaccggcctaagttacgttaaatttaccggttaggttacggttagggggtacctttaacgtttttaccgtacccggtacccccgggttaccgggggtaacccccgggggtaaccccttggggtacccctacccccgggttacccctacccccccgtacccccgtttaacccccaaaccccgggg

SEQ ID NO: 416420 - DNA, 561 bp, Homo sapiens
  misc_feature: GZ8MTXP02F90ZA.22.85.H08.1.454.CMB.2.raw
  modified_base (349)..(349): a, c, t, g, unknown or other
  modified_base (473)..(473): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttctcagtggcgactacatgagctgggtccgccaggctccgaggggaacgggcctggagtggatctctacttattatagtggtgtaccanatactacacagctccgtgaagggccatcacatctcagaagacaatccaagaacactattgtatcttacaaatgaaactaaccgtagaacgagacccgaggacacggccagtgtatactggtggnggggtactatttacgtcgaccccgtcgggggacccgggtaacccgtcgggtaccgacccggtcctacccccgacccctccaaccccgg

SEQ ID NO: 416421 - DNA, 596 bp, Homo sapiens
  misc_feature: GZ8MTXP02JXFOI.22.85.H08.1.454.CMB.2.raw
  modified_base (361)..(361): a, c, t, g, unknown or other
  modified_base (575)..(575): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacagtgagcgtgggtcccgccgaggcctccgaggggaacgggccgtggaggtggatctctactttatttatagtggtcgtaccanatactacacagcgtcgtagacgggccattcaccatctcagaacgactaatccaggaacactagttactatcttaacaaatagaaactaaccgtagacggtagacccggaaggaccgacggacctagtacgtattaacgtggtggtaggggcttacgtttacgttcgaccccgggtgggggacccggggtaaccgtcggtaccgtacccggtccncccccaccctacccaacccgg

SEQ ID NO: 416422 - DNA, 647 bp, Homo sapiens
  misc_feature: GZ8MTXP02G8F8J.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttggatccagccgtgggggtccctgagactctcctgtgcagtctcgtgggttcgtcgaggtggcgactacagtgagtcgtcgggtcccgccgaggcctccggaggggacgggccgtagggaggtggactctctactttatttagtaggttggtacgtaccactatacgtacacagccgtccgtaggaacggggcctaattcaacctagtcctacaaagtaagaacctaaattacccgaaaggaacactattagtactacttaaacaaatagaaactaaccgtagaggtacgaccgaacgacgacggacctagttacgtattacgtgtgggtacgggtacttagttaccgttccggaaccccgggtcgggggtacccggtaaccgtcggtacccgtacccggtcccctacccccgaccctcccgaaaccccgg

SEQ ID NO: 416423 - DNA, 711 bp, Homo sapiens
  misc_feature: GZ8MTXP02ICJWZ.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtccctgagactctcctgtgcagtctcgtgggttctcagtggcgactacatgagcgtcgggtcccgccgaggccgtccgaggggaacggggcctggggagtggattcgtctaactttatttagtaggtggtaccgtaacccacgtataacctacaaccgacgtaccgtcccggtagggaaaccggggtcccgtaacgttaccaaacctactaccttacgaaagaaacgaactaaaacgttacccgaaaggaaaacctaactaagttacgttaacttacttaaacgaaattaagaaaacttaaaccgtaggaacgacgaccggaacggaccgaacgggaccctaagtacgtaagttacgttaggtacgggttggggtacttacgtttacgttaccgtaccccgggtacgggggacccggggtaacccgtcggtacccgtacccgttccccgtaccccccgtacccgtacccgaaccccgg

SEQ ID NO: 416424 - DNA, 698 bp, Homo sapiens
  misc_feature: GZ8MTXP02FICIG.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtggagggaggcttgatccgagccgtgggggtccctgagactctcctgtgcagtctcgtgggttcgtcagtggcgactacatgagtcgtgggtcccgccgaggctcccgaggggacggccgtagggagtggactctcgtaactttattaagtaggtggtaccggtacccacattactacacgacgacctccggtaggaacgggaccgattccacctatcctacgaaagaacgaactaacgttacccgaaaggaaacctaactaagtttagtaacttacttaaacctaaaagtaagaaaaccttaaccgtagaaacggacgaccggaacggaaccgaccggacctagttagttacgttaacgtggtagggtcggggtaactacgttttaacggttccggtacccccgggtcgggggacccccggggtaaacccgttcgggtaaccccgtacccggtccccctacccccgtaacccccgtccccgaaacccccgg

SEQ ID NO: 416425 - DNA, 687 bp, Homo sapiens
  misc_feature: GZ8MTXP02G5MHC.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggtcgtcaggtggcgactacatgagcgtcgggtcccgccgaggcgtccgaggggaacggccgtgggagtggatctctactttattagtaggtggtacggtaccactatactacacagaccgtccgtaggaacgggcctattcacctactctacaagaaacgaactaaacttacccgaaaggaaaccaataatttagttaaacttaaactttaaaaatagtaaaactaaccgttagaacgtaacggaccggaacggaaccgacggtacctagtacgttaacttacgtggttaggtacggggtacttacgtttaccgttacggtaccccgggtaccgggggtaccccggggtaacccggttaaccgggtacccgaccccggttaccccgtacccccgtaacccccgtaccccgaacccgtaaccccgggg

SEQ ID NO: 416426 - DNA, 695 bp, Homo sapiens
  misc_feature: GZ8MTXP02JTYS7.22.85.H08.1.454.CMB.2.raw
  modified_base (359)..(359): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgtgggttcgcagtggcgactacatgagcgtgggtcccgccgaggctccgaggggaacggccgtggagtggatctactacttatttagtgtggtcgtaccanatactacacagacctccggtaggaacgggccgtattccgaacctagtcctacgaaagaaacgtaactaaacttacccgaaaggtaaacctaactaaagtttacgttaacttacctttaaactaaaattaacggtaaaacttaaacccgtaggaacggaacgacccggaaagggaccgaccgggaccctagttacggttaattaccgttaggttagggtacgggggtacttacgtttaccgttccgggaaccccggttcgggggaccccggggtaaccccgttcgggtacccgtaccccggtccccgtacccccctacccgtaccccaaaccccggg

SEQ ID NO: 416427 - DNA, 691 bp, Homo sapiens
  misc_feature: GZ8MTXP02JKB54.22.85.H08.1.454.CMB.2.raw
  modified_base (452)..(452): a, c, t, g, unknown or other
  modified_base (504)..(504): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggtagttttggctgagcgttgggttttccttgttgcttatttacaaaaggtgtccagtgtgaggtgctaggttggtggagacgtggaggaggcttgatccaggccggtgggggtccctgagtactctccgtgtgcagtctcgtggttcgcagtggcgtactacagtgagcgtcggtcccgcgcggcctccggaaggggacggccgtggacggtggtatcgttactaactttaatttagtaggttcggttacggtaaccctaactattaacctaacaaccgaagtaccgttccgggtaaggaacgggtacctattacccaccttanactacgaaagaactaactacgtacccaaagaccaatattagactttctaaanaaagttagaaacttacgagaagacgaccgaagtaccaggctagttagtaacttgtaggttgggaggaacctttaagttacccgttaccggaccccccggggtagggggtacccccgggtaaaccccttcggggttaaaccccctacccgtacccccttacccccgaaaccccgtacccgaaacccgg

SEQ ID NO: 416428 - DNA, 594 bp, Homo sapiens
  misc_feature: GZ8MTXP02GGC1W.22.85.H08.1.454.CMB.2.raw
  modified_base (399)..(399): a, c, t, g, unknown or other
  modified_base (417)..(417): a, c, t, g, unknown or other
  modified_base (422)..(422): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagttctcgtgggttcgtcaggtcggcgactacatgacgcgtcggggtcccgccgaggcctacccggaggggaacgggccgtaggggaacgtggacttcgtctaactttatttagtagttggtacgtaccatatactacacagcctcgnggaacgggccattcactntctanaagaagactaatccgaagaccagtattgatcttacaaatagaactactgacgagacccgagaccacggcatagtactacgtgtggtggtacctagttaccgtcgaccccggtgggggacccggtaaccgtcggtacccacccggtccctacccccgtacctcccgaaacccg

SEQ ID NO: 416429 - DNA, 645 bp, Homo sapiens
  misc_feature: GZ8MTXP02JR3D7.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggctccgaggggacggccgtggagtggatcgtactactttatttataggttggtaccgtaaccacgtatactacacaagaccgtccgtaggaacgggtccgattaccaacctacttcacgaaagtaaacgaactaacttacccgaaaggaacccaagtattagtaacttccttaaacaaatacgtaaaataacctggaagacgacgaaggacctaacggcctagttagtaactagttgtagggtcgggtactacgtttaacgtccggtaaccccgggtcgggggaccccgggtaacgttcggtaccctaccggttcccctacccccgacccgtaccgaaaccccgg

SEQ ID NO: 416430 - DNA, 699 bp, Homo sapiens
  misc_feature: GZ8MTXP02IKREN.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtcctgagactctctgtgcagtcttcgtgggttctcgagtggcgatacatgacgcgtgggtccgccgaggctccgaaggggacgggcctggaggtggactctcactttaatttagtaggttggtccgtaaccatactaacgacaacacgtccgtaccgtagggaaacggggtcccgtattaccaacctatccctacaacggaaacgaaactaaacgttacccgaaacgggaaacctaacttaacgtttacgtaacttacttaaaccgtaaaattaacggtaaaacttaaccctaaggagaacgccgaaaggaccacggacctagttacgtattaacgttcggtaggtacggggtacttaacgttttaccgttaccgaaccccgggttcgggggaaccccgggggtaacccgttcggtacccgtaccccggttccctacccccgtaaccccgttcccgaaaaccccgg

SEQ ID NO: 416431 - DNA, 570 bp, Homo sapiens
  misc_feature: GZ8MTXP02FPFQ9.22.85.H08.1.454.CMB.2.raw
  modified_base (358)..(358): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtggggggtccctgagactctcctgtgcagtctcgtgggttcgtcagtggcgactacatgagctggggtccgccgaggctccgaggggaagggcctggagtggatctcactttattagtagtggtacggtaccanatactacacagactccgtagaacggggccgattcgaccatcctacaagaacgacaattccaggaacactattgtatcttacaaatgaatacctagagagccgaggacacggccatgtattactgtcgtgggctatttacttcgaccccgtcgggggacccgggtaacccgtcggtaccacccggtccctacccccaccctcccgaaacccgg

SEQ ID NO: 416432 - DNA, 660 bp, Homo sapiens
  misc_feature: GZ8MTXP02FXLAX.22.85.H08.1.454.CMB.2.raw
  modified_base (325)..(325): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgctaggttgggtggagacgtgggagggaggtcttgactccgaggtccggtggggggtccctggacgtactctccgtgtgctacgttctcggttgggttctcgaggtcggcgtaactacagtgagcgtcgggtccnccgaggcctacggaggggacggcgtggagtgatcctatacttagttagtaggtggtaccgtaccacatacacacagtcctcgtagacggtcctatccactctactacgaaaggaacaactaacttaccgaagaacctagtatttagacttacttaaacaaattagaaacttacgaggaacgacgtaccggagaccacggtactagtactagtacgtgtcggttaggactttaagttaccggtacccggtaccccgggtcgggggtaacccccggttaacgtacccgggtacccacccccggttacccctacccccgtaccctaaccccgaaccgg

SEQ ID NO: 416433 - DNA, 769 bp, Homo sapiens
  misc_feature: GZ8MTXP02ITKRH.22.85.H08.1.454.CMB.2.raw
  modified_base (265)..(265): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcttgggttttccttgttgctatttacaaaggtgtccagtgtgaggtgcaggttggtggagacgtgggaggaggtcttgactccgaggtccggtgggggtccctgacgtactctcctgtgcngttctcgtgggttcgtcgaggtcggacgactacagtgacgtcggtcgggtcccgccgacggccgtaccggaaggggaacgggtccgtagggaggtggtactccgtacttactttaagtttaagtagggttacggtaccggtaaccctacgtaacttaacctaacctaaccgaacgtacccgttaccgggtaagggaaaccggggtacccgtaacttacccaaccgtactaccctaacgaaacggtaaacaactaaacgttacccgaaaggtaaaccctaagttaactttacgttaacttaccttaaaataaaattaaacggtaaaacttaaccgtagaacggacgaccgaaggaccgtacgacctagtagttatacgtggtcggtacggtctttaacttaccggtccggtacccccgggtacggggtaccccggggtaaacccggttcgggtaaccctccccgtaccccgttacccccccacccgttaaccccgaacccccggg

SEQ ID NO: 416434 - DNA, 546 bp, Homo sapiens
  misc_feature: GZ8MTXP02GIVM0.22.85.H08.1.454.CMB.2.raw
  modified_base (356)..(356): a, c, t, g, unknown or other
  modified_base (393)..(393): a, c, t, g, unknown or other
  modified_base (400)..(400): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccgccaggctccgaggggaagggcctggagtggatctctactttattataggttggtcggttaccanatactacacagctcgtagaacgggccattcacatctnagaaganaacttcagaacacatgtatcttacaatagaataacctgagagccgaggacacggcatagtatacgtgtgtggggctagttactcgacccgtggggacccgggaaccgtcggtaccacccggtctacccccaccctccaaaccccgg

SEQ ID NO: 416435 - DNA, 558 bp, Homo sapiens
  misc_feature: GZ8MTXP02JKKTZ.22.85.H08.1.454.CMB.2.raw
  modified_base (408)..(408): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtcccgccgaggctccgaggggaaggcctggagtggatcgtcactttattatagtggtcggtaccacgataactacacagactccgtgaaacgggcccgattcaccatctcaagaaganaacttcccagaaacacattgatcttacaaatagaaataacctgagagaccgaggacacggcatcgtatatgtggtgggctagtttctcgaaccccgtggggacccgggtaacctcggtaccaccggtcctaccccacccgtccaacccgg

SEQ ID NO: 416436 - DNA, 1011 bp, Homo sapiens
  misc_feature: GZ8MTXP02I4VXI.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagacgtggaggaggcttgatccgagccggtcgggggtccctgagactctcctgtgcagtctcgttgggttcgtcgaggtggcgactacagtgaggcgtcggggtcccgcgacggccgtaccggaaggggaacgggtccgtgggtaggtcggtacttccgttacgttaactttaagttttagtacgggttgggtacccggtaaccctaacgtaacttaaccttaaccgaaccgtacggtaccgttaccggtagggaaaccggggtaccctaacgtttaccaaacccgttactaccgtaacgaaaggtaaaaccgaaaccgtaaactttacccgaaaaggtaaaaccctaacgtttaacgtttacgtaaactttaccgtttaaaacctaaaagttaaaacgggttaaaacccttaaaacccggttagggtaaaacggggtaaacccgggaaacccccggggtaaacggggtaaaacccccggaaaccggggttacccctaaagggttttaaaccgggtttaagtttaaaaccccgggggtttggggttacgggggttacccgggggttaaccctttaaaaccgggtttttaacccgggtttacccccgggggttaaacccccccgggggtttcccggggggggggtaaaaccccccccgggggttttaaaacccccgggtttcccccgggggttaaaccccccccgggttaaaccccccccgggggttttaaaccccccccgttacccccccccggttaaacccccccccggttaaaaccccccggggtttaaaaaacccccccccggggg

SEQ ID NO: 416437 - DNA, 670 bp, Homo sapiens
  misc_feature: GZ8MTXP02JO2WI.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttcgtcagtggcgactacatgagcgtcgggtcccgccgaggcctaccggaggggaacgggcccgtggaggtggtactcgtctactttatttagtaggttggtacggtacccaactacgtaacctaacacaacgaccgttacccggtaggaaacggggtccctagttaccaacccgtatcctaccgaaagaaacgactaaacttacccgaaggaaccaactatttagtacttacgtttaacaaattagaaacttaaccgtagaacggagacccgaaggaccgaacggacctattacgtacttacgtggtggtggggactacgttacgttacgtacccggtaccggggaccgggggaacccgttacggtcccgtacccgtcccgtcccctacccccgtacccgtaaccccgg

SEQ ID NO: 416438 - DNA, 589 bp, Homo sapiens
  misc_feature: GZ8MTXP02FXML0.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgcaggctccgaggggaaggcctggagtggatctctacttattatagtggtaggtaccacatactacacagctccgtagacgggccattcaccatctacaagaagactaattcccaaaggaaccatattgtaatcttacaaaatgaaatacctgaagacgaccgaaggacacggaccagtagtattacgtgtggtggacgtactttacgttaccggtaccccggtcgggggtacccgggggaaccccgtacggtcccgtaccccggtccctccccgtaccccctaccgaaacccccgg

SEQ ID NO: 416439 - DNA, 674 bp, Homo sapiens
  misc_feature: GZ8MTXP02JSY9D.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtccctgagactctcctgtgcagtctcgtggttcgcgagtggcgactacatgagcgtcgggtccgccgacggctccggaggggaacggccgtggaggtggatctctactttaattagtaggtggtccgtacacactactacacagtccgtcgtaggacggccgtacttacgacctactacctagaaagaacgtaactaaacttacccgaaaagaaacctaacttacgttataacttaccttaaacaaatagtaaactaacgtagaacggaacgccggtaacggaccgtaccggactagttacgttacgtacgtgggttcgggcgggtactttaacgttaccggttccgggaacccccggttggggggacccccggggtaaaccgttccgggtaccctaccccgggttcccctaaccccccgtaccccggtacccgaaaccccgg

SEQ ID NO: 416440 - DNA, 746 bp, Homo sapiens
  misc_feature: GZ8MTXP02IIM7D.22.85.H08.1.454.CMB.2.raw
  modified_base (446)..(446): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggacgactacatgagcgtcgggtcccgcgacggccgtaccgaggggaacgggccgtggaggtggatccgtactactttaatttagtaggtggtccggtaaccacgtatacctacaaccgacgaccgtccggtaggaaacgggggtaccctaacgttccaacctactacccgtanaaacgaaacgactaaaacttcccgaaaggaaccctaatatttacgtaacttacttaaactaaaacgttagtaaaacttaacccgtagggaaacggtaacggaccccggaaagggacccgaaccgggtacctaagttacgttaaacgtttaccgttagggttcggggtacggggtaccttaaacgtttaaccggttacccgggaacccccgggtttcggggggaccccgggggtaaacccgttcggtaccccgtacccgtttacccccgacccccgttaaccccgtacccgaaaccccggg

SEQ ID NO: 416441 - DNA, 598 bp, Homo sapiens
  misc_feature: GZ8MTXP02ITB41.22.85.H08.1.454.CMB.2.raw
  modified_base (395)..(395): a, c, t, g, unknown or other
  modified_base (405)..(405): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagactgggagggaggcttgatccgagccgtgggggtccctgagactctcctgtgcagtctcgtgggttcgtcagtggcgactacatgagcgtgggtcccgcgacggctccggaggggacgggccgtggaggtggatctctactttattataggtggtcgtaccacatacacacagctcgtgaacggcctatcacntctcaagaanactaataccgaagaacacgtaattagtactacttaataaatagaaacttacgtgaagacgaccggaacggacgacggacctagttacgtacttacgtgtgggtgggtacttacgtttacgtccggacccggtcgggggacccggtaaccgtcggtaccgtacccgtacccgtcccccaccctacccgtacccg

SEQ ID NO: 416442 - DNA, 762 bp, Homo sapiens
  misc_feature: GZ8MTXP02F8NS3.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtcgggtccgccgaggcctacccggaagggggaacgggcccgtagggaggttggaacttcgttactaacttttaatttaagtaggttggtccggttaacccactaattaacctaacgaaccaacgtacccgtacccggttaaggaaaccgggggtcccgtaactttacccaacctactccttacgaaaggaaacgaaactaaacctttacccgaaaaggtaaaccctaaataacgttttacgtaaattaccctttaaacggaaaattaggtaaaactaaacccgttagaaacgggacgaccccgggaaggaaccgtaacgggacctaagttagtagtttaaacgtggtggtacggggtattaacgttttaccggttaccggacccccggttagggggtaccccggggtaacccgttcggtaccccgaccccggttcccccgtaccccctaacccccgtacccgaaaacccccggg

SEQ ID NO: 416443 - DNA, 719 bp, Homo sapiens
  misc_feature: GZ8MTXP02I0WHV.22.85.H08.1.454.CMB.2.raw
  modified_base (172)..(172): a, c, t, g, unknown or other
  modified_base (377)..(377): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttcctgttgctatttcaaaggtntccagtgtgaggtgcagttggtggagacgtggaggaggcttgatccagccgtgggggtcctgagactctcctgtgcagtctgtggttcgtcagtggcgactacagtgagctcgggtcccgccgtaggctccgagggaacggggcctggacgtggacttctcgtacttatttatggttggtcggtaccactataactacaaccganaccgttccgtaggaaacggggtccccgtaatttccaaccgtatactacagaaaacgacctaaacgttacccgaagggaaaccctacgtaatttcgtattacctttacaaaacgttagtaaaacgttaacctggaaacggaacgacccgggaggttaaccacgggtaaccagtttaggtaacgtttaaccgtacggtgggttacgggggtaccttaacgttttaccgtttacccggggaccccgtttaacggggggtaccccggggtaaacccgttcgggggttaacccctaacccggttccccgttacccccccaaccccgtttaccccggaaaaccccggg

SEQ ID NO: 416444 - DNA, 562 bp, Homo sapiens
  misc_feature: GZ8MTXP02ILKN3.22.85.H08.1.454.CMB.2.raw
  modified_base (282)..(282): a, c, t, g, unknown or other
  modified_base (359)..(359): a, c, t, g, unknown or other
  modified_base (373)..(373): a, c, t, g, unknown or other
tcagacatacgcgtcacgaccggtgctcgatttagtatcactcagtcgcgggaggacgctgaccacacggtacgtgctgttgtactgctcctcccgcggctttgtcttggcattatgcacctccacgccgtccacgtaccagttgaacttgacctcagggtcttcgtggctcacgtccaccaccacgcatgtgacctcagggggtccggagatcatgagggtgtccgttgggtttgggggagaggagcccagcactgggattccgaggtgttccagttcggngatcagcactgaacacagaggactcaccatggagtttggctgagtcgttgggttttctgttgctattccaaaaggtntcagtgtgagtcgngtagttgggtgacgtagtgggaggagtcgtgacgtccgaggccggtgggggtccctaggacgtactctccgtgtcgctagttcgtcgttgggttcgtcgaggtcggcgtactacgagtgacgtcgtcgggtcccgcgacggcgtccggagggacggccgtgggagtggactccgtatactttatttagg

SEQ ID NO: 416445 - DNA, 667 bp, Homo sapiens
  misc_feature: GZ8MTXP02IOJBO.22.85.H08.1.454.CMB.2.raw
  modified_base (325)..(325): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtggaggagcttgatccagccgtggggggtccctgacgactctcctgtgctagtctcgtggtcgtcagtggcactacagtggagcgtcgggtccgcgaggcgtccggaggggaagggcctggngtggactctactactttattagtaggttcggtacgtaccactactactacaacgacgtaccgtccggtaggaaacgggcctacgttccaactatacctacaaaggaacgaactaaacttcccgaaaggaactaactatttagtacttacttactaaaatagaaactaccgtagacgaacgccgaaggacctacggacctagttagtaacgttcgtagggttcgggtacggggtacttaacgtttacgttacccggggtacccggggttcgggggtaaccccgggtaaccgtccggtaccgtaccccgtaccccgtacccctaccccgtacccgaaaccccgg

SEQ ID NO: 416446 - DNA, 728 bp, Homo sapiens
  misc_feature: GZ8MTXP02I1XWI.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtcccgccgaggcctccgaggggaacgggccgtggaggtggatcgtctactttatttatggtggtacgtaccactatactacacagctcgtggaaggccgtattcacctatctacaagaaacgaactaaacgttacccgaaaggaacctaactagtttacgtacttacgtttaaaccaaaattacggtaaaactttaaacccgtagggtaacggtaaacggacccccgggaaagggaacccgaacccgggtaccttaagttaggttaaaccgtttaaccgtgggttaacggggttcgggggtaccttaaaacgtttttccggtacccgggtaacccccggggttcggggggaccccggggttaaaccccgttcgggggttcccctaacccccggtttcccctacccccccggtaacccttacccccggaaaacccggg

SEQ ID NO: 416447 - DNA, 588 bp, Homo sapiens
  misc_feature: GZ8MTXP02FLODV.22.85.H08.1.454.CMB.2.raw
  modified_base (252)..(252): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccaggccgtggggggtccctgagactctcctgtncagtctctgggttctcaggtggcgactacatgagctgggtccgcaggctccgagggaaggccctgggacgtggatctcgtactttattataggtgtcggtaccacgatactacacagactccgtgaaacggggccgattcacctagtctcaagaagaacaattaccgaggaacaactaattgtaatcttacaaatagaataacctgacgagcccgaagactacggaccagtgtacttacgtgtaggtggggtacttatttacgtacggtaccccgtgggggacccggtaaacccgtcgtaccgaccggtccctacccccacccgtccaaaccccgg

SEQ ID NO: 416448 - DNA, 648 bp, Homo sapiens
  misc_feature: GZ8MTXP02GZIYB.22.85.H08.1.454.CMB.2.raw
  modified_base (256)..(256): a, c, t, g, unknown or other
  modified_base (422)..(422): a, c, t, g, unknown or other
  modified_base (426)..(426): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtgggaggaggcttgatccaggccgtgggggtccctgagactctctgtgcngtctgtgggttcgtcaggtggcgactacgatggacgtcgtggggtccccgccgaggcctccggaaggggaacgggccgtgggacggtggacttccgtactactttaatttagtaggttggtaccgtaccatatactacacagcctcggaggaacggcgtactcacnctcnaagaacgacaattcgagaacactattagtactcttaaacaaagttacaaacttaaccgtagaggacgacccgaaggaccgacggacagttacgtaattacggtggtcggttgggactttacgttaccgttccgggacccccgggttagggggccccggggtaacccgttcgggaccctaccccggtacccctaccccccgtacccgtacccgtaaccccggg

SEQ ID NO: 416449 - DNA, 680 bp, Homo sapiens
  misc_feature: GZ8MTXP02GLK9W.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtcgggtccgccgaggcctaccggaggggaacggggtcctgggacggtggactccgtactaactttatttaagtaggttggtaccggtaccaactaataactacaacacgaccgtccggtaggaaacggggccctattaccaaccctaatcctacgaaagaaacgaacctaaacttaaccgaacggaaaccaactaatttactaactcttaaacaaagtaaagtaaactaaacctagaaaggacgaaccgaaggaccacggacctagtagtaattacgtggtaggtacgggtactagttttaaccgtcggtaaccccggtcgggggaacccggggtaaccccgtacggtacccgtacccgtccccttacccccgaccccgtacccgaaaccccgg

SEQ ID NO: 416450 - DNA, 623 bp, Homo sapiens
  misc_feature: GZ8MTXP02I1V1N.22.85.H08.1.454.CMB.2.raw
  modified_base (253)..(253): a, c, t, g, unknown or other
  modified_base (514)..(514): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtcagtgtgaggtgcaggttggtggagacgtggaggagggcttgatccgagccgtgggggtccctgacgactctccggtnccagtctcgtgggttcgtcagtggcgactacatgagcgtgggtcccgccaggctccgaaggggacggccgtggagtggatcgtcactttagtttataggtggttggtaaccccacgtatactacacagactccgtagagggccgtagttcacctatctacagaagtacaattccgaagtaacacattatatcttacgaaatgaaactacgtagagacgaccgacgacgacggtaccagtagtattacgtgtggtacgggtntaacgttttcgtaacgtccccggtacgggggtcccggggtaaacccgtcggggtaccccgtaacccgtcccctacccccgaccccttacccgaacccgtaaaccccggg

SEQ ID NO: 416451 - DNA, 547 bp, Homo sapiens
  misc_feature: GZ8MTXP02J0T62.22.85.H08.1.454.CMB.2.raw
  modified_base (291)..(291): a, c, t, g, unknown or other
  modified_base (294)..(294): a, c, t, g, unknown or other
  modified_base (335)..(335): a, c, t, g, unknown or other
  modified_base (350)..(350): a, c, t, g, unknown or other
  modified_base (406)..(406): a, c, t, g, unknown or other
  modified_base (412)..(412): a, c, t, g, unknown or other
  modified_base (418)..(418): a, c, t, g, unknown or other
  modified_base (429)..(429): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgtgctattcaaaaggtgtccagtgtgaggtgcagttggtggagactgaggaggccttgatccagccgtggggggtccctgagactctcctgtgcagtcttctgggtctcaggtgcgctacatgagctggggtccnccnggctccgaggggagggcctggagtggattctcacttatttntagtggtcgtaccanctactacacagctccgtgacggggcattcacatctcagaagcatcagaacacattnatctanaaatanatacgtagagngccgaggacacgcatgtattagtgtggtgggtactacttacgttaccggtacccggtcgggggacccggggtaacccgtcgtccgtacccgtcccctaccccctaccccacccgaccg

SEQ ID NO: 416452 - DNA, 602 bp, Homo sapiens
  misc_feature: GZ8MTXP02J0STT.22.85.H08.1.454.CMB.2.raw
tcagacatacgcgtcacgaccggtgctcgatttagtatcactcagtcggcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagcgtgggtccgccaggcctccgaggggacggcctgggagtcggatctcacttatttagtaggtggtacggtaccatatactacacagcctccgtagaacgggccgtattccgaccatcctacaagaacgaacaacttacccgaaggaacactattagtactacttaacaaatagaaactacctagagtaacgcgaagacgacggccatgtacttacgtggtggtggggactagtttacgtccgtacccggtcgggggacccgggtaaccgtcgggtacccacccggtaccctcccccgtaccctacccgaaaccccgg

SEQ ID NO: 416453 - DNA, 551 bp, Homo sapiens
  misc_feature: GZ8MTXP02IWLSP.22.85.H08.1.454.CMB.2.raw
  modified_base (254)..(254): a, c, t, g, unknown or other
  modified_base (371)..(371): a, c, t, g, unknown or other
  modified_base (380)..(380): a, c, t, g, unknown or other
  modified_base (394)..(395): a, c, t, g, unknown or other
  modified_base (398)..(398): a, c, t, g, unknown or other
  modified_base (402)..(402): a, c, t, g, unknown or other
  modified_base (404)..(404): a, c, t, g, unknown or other
  modified_base (415)..(415): a, c, t, g, unknown or other
  modified_base (418)..(418): a, c, t, g, unknown or other
  modified_base (424)..(424): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcngtctcgtgggttcgtcagtggcgactacagtgagcgtcggggtcccgccaggctccgaggggaacggccgtggagtggatctctactttatttataggtggtcgtaccatatactanacagctcgngaaggcctatcacnnctnagananatcagacactntanatctanaaatgaaatactgacgagcgagacaggacatgtattactggtggtgggacttagtttacgtacgacccggtcgggggacccggtaaccgtcgtccgacccgtcctacccccgacctcccaaacccgg

SEQ ID NO: 416454 - DNA, 561 bp, Homo sapiens
  misc_feature: GZ8MTXP02FI2AW.22.85.H08.1.454.CMB.2.raw
  modified_base (364)..(364): a, c, t, g, unknown or other
  modified_base (398)..(398): a, c, t, g, unknown or other
  modified_base (403)..(403): a, c, t, g, unknown or other
  modified_base (422)..(422): a, c, t, g, unknown or other
  modified_base (479)..(479): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtgggagacgtggaggaggcttgatccgagccgtgggggtccctgagactctcctgtgcagtctcgtgggttcgtcagtggcgactacatgagctgggtccgccgaggctccgaggggaacgggccgtggaggtggatctactactttattataggtggtacgtaccanatactacacagctcgaggacggccatcacatcanagaanacaatccgagacactattntatcttaacaatagaatactagagacgaccgaggacacggcatgtattacgtgtggngggtctagttactcggacccggtcggggacccgggtaaccgtcggtcctacccggtccctacccccaccctcccgaaacccg

SEQ ID NO: 416455 - DNA, 538 bp, Homo sapiens
  misc_feature: GZ8MTXP02IBP87.22.85.H08.1.454.CMB.2.raw
  modified_base (352)..(352): a, c, t, g, unknown or other
  modified_base (389)..(389): a, c, t, g, unknown or other
  modified_base (522)..(522): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtcccgccaggctccgagggaagggcctggagtggatctcacttatttatagtggtgtaccanatactacacagctccgtgaacgggccattcacatctnagaaagacaattccaggaacacattgatcttacaaaagtgaaataacctagagaacgccgagacacggcatgtatactgtgtgggctatttactcgacccgtggggaccgggaaccgtcggtacacccgtccnccccacctccaacccg

SEQ ID NO: 416456 - DNA, 542 bp, Homo sapiens
  misc_feature: GZ8MTXP02FLFYZ.22.85.H08.1.454.CMB.2.raw
  modified_base (360)..(360): a, c, t, g, unknown or other
  modified_base (391)..(391): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctaccgaggggaacgggcctgggagtggatctactactttattatagtggtcgtaccanatactacacagctcgtgaggccatcacatcnagaagacatccagacacattgatctacaaatagaactaactgagagaccgagacacggcagtgtatacgtgtggtgggctagtttacgtcgacccgtgggggacccggtaaccgtcggtaccacccgtcctacccccaccgtcccaacccg

SEQ ID NO: 416457 - DNA, 755 bp, Homo sapiens
  misc_feature: GZ8MTXP02IR0BF.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcactacatgagcgtgggtccgcgaggctcgaggggaagggcctggaggtggacttctctactttatttagtaggtggtacggtaaccacgtactactacacacgtaccgtccggtaggaacggggccgtacttacaacccgtatacctacgaaacggaaacgaacctaaacgttacccgaaaaggtaaacctaactaagtttagttaacttacctttaaacgaaaaactttaacggaaaacttaaaccgtagggaaacgaaccgggaacccgggaaacgggaacccgaacccgggtacctaagttacggttaactttaaccggttggggttacggggttacgggggttacctttaaacgtttttaccggttacccgggtaacccccggggtccggggggtaaccccggggtaacccgttcgggtaaccccgtacccccggtaccctacccccccgtacccgtaccccgaaaccccgggg

SEQ ID NO: 416458 - DNA, 791 bp, Homo sapiens
  misc_feature: GZ8MTXP02GRWL2.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggtttccttgttgctatttcaaaggtgtccagtgtgaggtgctaggttggtggagacgtggaggaggcttgatccagccgtgggggtccctgagtctctcctgtgcagtctcgtgggttcgcgagtggacgactacagtgaggcgtcgggtccgccgtaggcctaccggaaggggaacgggtcctagggaggtggacttcctacttacgtttaatttagtaggttgggtaccggtaacccacgtaataacctacacgacgtccgtccggtaggaacggggtcctataccaaccatacctacaaacgtaaacgactaaacttaccgaaacggaaactaacctagtttacgtaacttccttaaaacaaaacgttacggtaaaaactttaacccgaaggtaaccgggaaccggtaaacccggtaaaccggggaacccgttaacccggggaaccttaagggttaactttaacgttaaaccgttgggttacggggttacggggtactttaaacggtttttaacccggttaccgggtaaccccccgggggtaccggggggtacccccggtaaaacccgggttccggttaacccgtacccccggttccccctacccccccgtaacccccgtaacccgaaaaccccccgggg

SEQ ID NO: 416459 - DNA, 728 bp, Homo sapiens
  misc_feature: GZ8MTXP02JKJIK.22.85.H08.1.454.CMB.2.raw
  modified_base (299)..(299): a, c, t, g, unknown or other
  modified_base (481)..(481): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgactccgaggccgtgggggtcctgagactctcctgtgcagtctcgtgggttctcaggtggctactacatgagtcgtcggggtccnccgaggcgtccgaaggggaacggccgtggaggtcggactctacgtactttaatttagtaggttggtccggtacacgtataactacacgactaccgtccggtaggaacggggcctaacgtaccaacctataccctagaaagaacgaacttaacgttacccgaaaggtaaacctacgtaatttntaaaccttcttaaaactaaaaggttactaaaccttaaaccgtggaaaacgggacgaccggaaacgacccggacgtaccgtagttaagttacgttaactggggttacggtaggggtaccttaacggtttaaaccggttcccggggaaacccccgggttcgggggggaacccccggttaaccggttacccggttcccgtaaacccccggttcccctaccccccgacccgtacccgaaaaccccccgggg

SEQ ID NO: 416460 - DNA, 780 bp, Homo sapiens
  misc_feature: GZ8MTXP02GTZG6.22.85.H08.1.454.CMB.2.raw
  modified_base (423)..(423): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgcagctccgaggggaaggcctggagtggatcgtctacttatttagtaggttggtaccggtaccacgaacttactacaacaacgtcctccggtaggaaacggggtccgtattaccaccctaatccgttanaaacggaaacgaactaaactttacccgaaacggggtaaaccaccgtaagttttacgtaaactttacctttaaaccaaaaagtttgaaaaccttttaaacccgaggtaacggaaccggacccgaaacggggaacccacggggtaaccccaagtttaggttaaactttaccgttaagggttggggttacgggggtacctttaaacggttttaacccgtttaccggggtaaacccccccggggttggggggtaaccccccgggggtaaaacccgtttccggggggtaaacccctttaacccccggggtcccctttaaccccccccggaacccccggtttacccccgaaaaccccccgggg

SEQ ID NO: 416461 - DNA, 644 bp, Homo sapiens
  misc_feature: GZ8MTXP02J083H.22.85.H08.1.454.CMB.2.raw
  modified_base (301)..(301): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgctagtctcgtggggttctcagtcggcgactacagtgagcgtggggtcccnccgaggcctccgaggggtaacggccgtaggagtggatctcactttatttagtagtggtcgtaccatatactacacacgactccggtagacgggccattcacatccacgagaacgacaattcccagtaacactattgactctagaaatcgaaatacctgaagagccgaagaccgacggtaccattagtaacttaacgttcggtagggttcgggacttaaacgttttaccgtaccggtaacccccgggttcggggggaaccccggggttaaccccgttcgggggtaccccctaaacccgggtttccctaccccccccggaaccccttaccccgaaaacccccggg

SEQ ID NO: 416462 - DNA, 628 bp, Homo sapiens
  misc_feature: GZ8MTXP02G8D2G.22.85.H08.1.454.CMB.2.raw
  modified_base (347)..(347): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgccgaggcctccgaggggaaggccgtggagtggactcgtacactttatttanagttggtcgtaccacgtatactacacagaccgtccgtagaacgggcctagttcaccatctacaagaagacaacgttcccgaaggaaaccactatttgtaacttctttaaacgaaaacttaagaaacttaaaccgtgaacgaacgaccgaagaccgacgcctatagtattacgtggtaggtgggactatttaccgtcggtacccccggtgggggaccccgggaacccgttcgggtacccaccccggttcccgtacccccctacccgtacccgaaaccccggg

SEQ ID NO: 416463 - DNA, 605 bp, Homo sapiens
  misc_feature: GZ8MTXP02GEHYB.22.85.H08.1.454.CMB.2.raw
  modified_base (422)..(422): a, c, t, g, unknown or other
  modified_base (427)..(427): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgctagttggtggagacgtgggaggaggcttgactccgagccggtgggggtccctgagactctcctgtgcagtctcgttgggttctcgaggtggcgaactacagtggagcgtcggggtcccgcgaggcctaccggaggggacgggccgtgggaggtggactctacttactttattagttggtggtaccgtaccacatactacacagctcgtaggaaacggcctatcacatcanagaanacaactcgaaagaccatattgtattcttaagaaatagtaactaaccgtgagacgaccgagacgcgactatagtattacgtggttggagggtacttacgttcgtccggtaccccggtgggggaccccggtaacgtcggtaccgtacccgtcccgtacccccacccgtcccgaaacccgg

SEQ ID NO: 416464 - DNA, 768 bp, Homo sapiens
  misc_feature: GZ8MTXP02FN4B9.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagtactctctgtgcagtctcgtgggttctcagtggcgactacatgagcgtgggtccgccgaggcctccgaggggacgggcctgggagtggatctctactttagttagtaggtggtcggtacccatatactacacagcctccggtaggaacgggcctattcaacctactcctacaaagaaacgaaactaaacttacccgaaaggaaaccaactaatttgtaacttacctttaaacaaaacttagaaaaccttaaaccgtaggaaaccggaagggaaccccggaaggggaacccgaaccgggtaccctaagtttacgtttaaacgtttaacggttcgggtttagggggttacggggggtacctttaaacgttttaacccggttttacccggggtaacccccccgggggttacggggggggtaacccccggggggtaaaacccccgttccgggggttaacccccgtaaacccccgggtttcccccggtaaccccccccctaaccccccggtacccccgtaaaacccccgggg

SEQ ID NO: 416465 - DNA, 661 bp, Homo sapiens
  misc_feature: GZ8MTXP02FH262.22.85.H08.1.454.CMB.2.raw
  modified_base (298)..(298): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtggggtccnccgaggctccgaaggggaacgggccgtggagtggatctcactttattataggtggtcgtaccacatactacacagactccgtaggaacgggcccgattacaccctatcctacaaagaaacgaactaaacttacccgaaagggaaaccaactaagtttgtaaactacctttacgaaaatagtaaactaaaccgtagaacggagacccgaggaccgacggacctaagtagttaacttaagtcggttaggtgggggtacttagtttaccgttaccggtacccccggtcgggggaccccgggggtaacccgttcgggtacccgtaccccggtcccttacccccgaacccccttccccgaaaccccgg

SEQ ID NO: 416466 - DNA, 676 bp, Homo sapiens
  misc_feature: GZ8MTXP02JOXY6.22.85.H08.1.454.CMB.2.raw
  modified_base (301)..(301): a, c, t, g, unknown or other
  modified_base (484)..(484): a, c, t, g, unknown or other
  modified_base (493)..(493): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgacgactctcctgtgcagtctcgtgggttctcaggtggcactacagtgagcgtggggtcccncgaggcctaccggaggggacggccgtaggcgtggtaacttcctcgttactttatttagtaggtggttaccggtaccactactactacacgacgtccgtccggtagaacggccgtattccactacgtcacgaagtaacgactaagttacccgaaaggaaccactaatttagtacttaccttaanaaacgttanaaacttaccgagagaccgaccgaaggacgaccggactagttacggttaaacttcgtgggttacgggtagggtaaccttagttttaacccggtacgggtacccccgggttacgggggaccccgggtaaaccgttcggttaccccgacccggtttcccacccccgtacctaccccggaaacccgg

SEQ ID NO: 416467 - DNA, 637 bp, Homo sapiens
  misc_feature: GZ8MTXP02G4X6H.22.85.H08.1.454.CMB.2.raw
  modified_base (253)..(253): a, c, t, g, unknown or other
  modified_base (284)..(284): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggagcttgatccagccgtgggggtccctgagactctcctgtgcngtctcgtgggttcgtcgaggtggcgactacntgagtcgtcgggtccgcgaggcgtccggaggggacggccgtggaggtggacttctacgtactttagtttagtgggttggtaccggtacctacgtactactacgaacacgtaccgtcggtagggaacgggccgtattcaccagtcctacgaagaaacgataaacgttccgaaaggaacactagttactacttacctttacaaagttataaactaaccgtagagaacgcgaaggacacggctagttacgtagtaacgtggtggtcggtacttaaacgttccgtaccggttaccgggcgggggtacccggtaacgtcgaccgtacccgtcccaccccctacccgcctaaacccggg

SEQ ID NO: 416468 - DNA, 690 bp, Homo sapiens
  misc_feature: GZ8MTXP02IO3NY.22.85.H08.1.454.CMB.2.raw
  modified_base (344)..(344): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtcgggtccgccaggctccgaggggaaggccgtggagtggatcgtctacttatttanaggtggtacgtaccacatactacacacgccgtcgtaggaacgggtccgtattcacctacgtctcgaaagaaacgaactaacttacccgaaggaaacctaactaactttacgtactaccttactaaaacgttacgtaaaacttaaccgtagaacgggaacgaccgaacgggtaaccacggacccgtaaattaggttaaacttaacggttagggtacggtttagggggtaccttacgttttaaccggtaccggtacccccggggttacgggggaccccgggggtaaacccgttcgggtaccccgtacccggtcccctaccccctacccgttacccccggaaaccccgg

SEQ ID NO: 416469 - DNA, 764 bp, Homo sapiens
  misc_feature: GZ8MTXP02GWPXP.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttccaaaaggtgtccagtgtgaggtgctagttggtggagacgtggaggaggcttgatccgagccgtgggggtccctgagactctcctgtgctagtctcgtgggttcgtcagtggcgactacatgagcgtgggtcccgccaggctaccgaggggaacggccgtggagtggatcgtactacgtttatttagtaggtggtacggtaacccactaagttaacctaacacgtaacgtccgttccgggtaggaaaccgggggccctaactttcccgaacctaacttccgtaacaaaggaaaacgtaacctaaaacgtttacccgaaaagggtaacctaaacttaaagtttacgttaaacttactttaaacctaaaattacggtaaaacttaaacccgtaggaaacggaaccggacccggaaacgggaaccgaaccgggacccgtaatttagttaaacgtttaaccgttcgggtagggttacggggtactttaaacggttttaccgtaccgggtacccccggtcggggggtaacccccggggtaacccgttcgggtacccgtaccccggttcccctaccccctaccccgtaccccgtaaaccccgg

SEQ ID NO: 416470 - DNA, 806 bp, Homo sapiens
  misc_feature: GZ8MTXP02GHP1I.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggcccgggggtcctgagactctcctgtgcagtctcgtgggttcgtcagtggcgactacatgagtcgtgggtcccgccagggcctccggaggggtaaacgggccctgggaggtggaatctcgtaactttagtttagtaggtgggttacggtaacccctaacgtacttaacgtaaccaacgaacgaccgttcccgggtacgaaacgggggccctaaactttcccgaaccctatcccttaaccgaaaggtaaaacgaaaccctaaaactttcccgaaaagggtaaaaccctactaaactttaggttaataccctttaaaactaaaagttaacgaaaactaaaccgtaggaaacgtaacggaccggaaacggaccgaccgggtaacctaagttcgtttaacgtttacggtaggggtttacggggtacggttaccgtttaaacgttttacccggttaccccggggaacccccgggggttaccggggggtaacccccgggtaaacccgttccggggttacccccgtaacccccggtttaccccccttacccccccgaaccccgtaaccccggaaacccggtaaaccccgggg

SEQ ID NO: 416471 - DNA, 610 bp, Homo sapiens
  misc_feature: GZ8MTXP02F40ZZ.22.85.H08.1.454.CMB.2.raw
  modified_base (362)..(362): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatctagccgtggggggtccctgagactctcctgtgcagtctcgtgggttcgtcgagtggcgactacatgagcgtgggtccgccgaggctccgaggggaacgggccgtggagtggatctctacttatttataggtggtcgtaccanatactacacagctccgtaggacgggccattccaccatactacaagaagaactaacttaccaaggaaccaactattgtaacttcttaactaaagtagtaaactaactaggaacgagacccgaaggacgacggccatagtacttacgtcggtaggtgggtacttagtttacgttcggtaccccggtcgggggacccgggtaaccgtcggtaccgtacccggtccctacccccgcccgtacccaaccccgg

SEQ ID NO: 416472 - DNA, 626 bp, Homo sapiens
  misc_feature: GZ8MTXP02FVD0I.22.85.H08.1.454.CMB.2.raw
  modified_base (326)..(326): a, c, t, g, unknown or other
  modified_base (377)..(377): a, c, t, g, unknown or other
  modified_base (414)..(414): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgttgggttcgtcgagtcggcgactacatgagcgtcgggtcccgcgaggcctccgaggggacggccgtggngtggatcgtctactttattataggttgtccgtaccactatacctacacganccgtcgtaggaacggccgaattcgacctataccctanaaacgaacgaactaacgttcccgaaaggaaccaacgtattagtacttacttaacaaattagaaactaacgtggaagacgaccgaggaccgacgacgatagttacttacgtgtcggtagggtctaacgtttcgtaccgtacccggtcgggggaccccgggtaaccgttcggacccgtaccccgtccctaccccgtaccctaccccgaacccgg

SEQ ID NO: 416473 - DNA, 720 bp, Homo sapiens
  misc_feature: GZ8MTXP02HKBYU.22.85.H08.1.454.CMB.2.raw
  modified_base (300)..(300): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctaggttggtggagacgtgggaggaggtcttggactccgaggcccggtggggggtccctggacgtactcctctgtgcagtctcgtgggttcgtcgagtggcgactacntgagcgtggggtcccgccgaggcctaccgaggggacggccgtgggagtggactctctaactttaatttagtaggttggtaccggttacccaatacttaacgtacacgaacgtccgtcccggtaggaaacggggtccactttcgaaacctatcctacaaggaaacgataaaccttaccgaaggaaccaatatttagtacttaccttaacaaaattacgaaaactttaaaccgaggaacgggaacgaccgggaacggaacgtaaccggccgtaattaggttaaaaccttgttagggttgggcgggtactttaacgtttaccgtacccgggtaccccgggttggggggtacccccgggtaaccgttcgggtacccctaccccggttccccacccccctacccgtaaccccgtaacccccgggg

SEQ ID NO: 416474 - DNA, 613 bp, Homo sapiens
  misc_feature: GZ8MTXP02GDERW.22.85.H08.1.454.CMB.2.raw
  modified_base (294)..(294): a, c, t, g, unknown or other
  modified_base (402)..(402): a, c, t, g, unknown or other
  modified_base (441)..(441): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgcagtggcgactacatgagcgtggtccncgaggctccgaggggaacgggcctggacgtggatctctaactttatttagaggtggtcggtaccacatactacacgagtctccgtaggaaggccgtacttacacctanactcgaagaaagaacaattaccaggaacacattagtatnttaacaaatagaactaactagagacgaccgagacgacggcatagtattaacgtcgtggtcggggacttacgtttaacgttccggtacccccgggtagggggtaccccgggggtaaacccgtcgggtacgtaccccggttcctaccccccgacccttacccgaaacccccggg

SEQ ID NO: 416475 - DNA, 717 bp, Homo sapiens
  misc_feature: GZ8MTXP02FKKV3.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggtcttgatccaggccggtggggggtccctgagacctctccgtgtgcagttctcgttgggttcgtcgaggtcggcgactacagtggagcgtgggtcccgccgaggctccggaggggacgggcctagggagtggatctactactttattagtaggtggtacgtaccacatacctacacacgtccgtccggtaggaaacgggcccgaattaccacctatcctacgaaacgaaacgaaactaacgttacccgaacggaaacctaacgtaatttagttaacttactttaaacaaaattacggtaaaactaaccgtaggaacgggacgacccgaacgggaccgaaccgggacctaagtagtttaacttaacgttgggttagggttacggggtactttaaacggtttaccgttacccgggtaacccccgggtcgggggtaccccggggtaacccgttcgggtaccccgtaccccggtcccctacccccgtacccccgtacccgaaaccccgg

SEQ ID NO: 416476 - DNA, 702 bp, Homo sapiens
  misc_feature: GZ8MTXP02JAGIR.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtgggaggaggcttgactccaggccgtgggggtccctgagctctcctgtgcagtctcgtgggttcgtcgaggtggcgactacatgacgcgtcgggtccgccgaggccgtccggaggggaacgggccgtgggaggtggacttctactactttagtttagtaggtggtaccgtaaccacgtaatacctacacgacgtaccgtccggtaggaacgggcctacttaccgaacctactaccgtacaaaggaacgtaactaacttaccgaaggtaaacctactaagtttacgtacttcgttaaactaaaattaggtaaaaccttaacggtagacggtaacgaccggaaggaccacggactagtacgtattacggtggttaggtcgggtactttacgtttaccgtaccgggtaacccccgggtggggggaacccccggtaacccgttcggtacccctacccccggttacccctaccccccgtaccccgttaccgaacccccgg

SEQ ID NO: 416477 - DNA, 603 bp, Homo sapiens
  misc_feature: GZ8MTXP02JXR9L.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgcgaggctccgaggggaggcctggagtggatctctacttatttatagtggtcggtaccatatactacacagacctcgtagacgggcctagttcaccatctacaagaagactaacttcccgaaggaaccactaattagtacttacttactaaatagtaactaaccgtagagacgaccgagaccgacggccatgtattacgtggtggtggggtacttagtttacgtaccgtaccccggtcgggggacccggtaacccggttcggtaccgtacccgtcccgtacccccgtaccccgtacccgtaaccccgg

SEQ ID NO: 416478 - DNA, 660 bp, Homo sapiens
  misc_feature: GZ8MTXP02JSTZQ.22.85.H08.1.454.CMB.2.raw
  modified_base (263)..(263): a, c, t, g, unknown or other
  modified_base (491)..(491): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcgtggtttctgtagctattcaaaggtgtcagtgtgaggtgcaggttggtggagacgtggaggaggcttgatccagccgtgggggtccctgagactctcctgtgcagtctcgtgggttcgnaggtggcgactacatggagtcgtcgggtcccgccaggcctaccggaggggaacggccgtagggagtaggacttcctacgtactttaagtttagtaggttggtaccggttaccacattacgtaacaccagtccgttaccgaggaaccgggcgtaacttcaaccgtataccgtagaaacggtaacgaacctaacttacccgaaaggtaaacccattacgttgtaactttntaaaccaaagttagaaacgttaccgagacggacgaccggaaggaccacgggacctagttacgtaattcggtgttaggggcggtacttgtttacgttacccggacccggtcgggggaccccgggtaacctggttacccacccgtccctacccccgactacccgaacccgg

SEQ ID NO: 416479 - DNA, 700 bp, Homo sapiens
  misc_feature: GZ8MTXP02IIBO1.22.85.H08.1.454.CMB.2.raw
  modified_base (384)..(384): a, c, t, g, unknown or other
  modified_base (477)..(477): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaggtgtccagtgtgaggtgcagttggtggagactggaggaggcttgatccagcctggaggggtccctgagactctcctgtgcagttctcgtggggttcgtcagtggcgactacatgagctgggtccgccaggcctaccggaggggaagggccgtaggacgtgggactcgtactaactttatttagtagtgggtacggtaccactattactacacngaccgtccgtaggaacggggcctattaccaccattcacaaggaacactaaattacccgaaggaaaaccataatttgttaaactacctttaaanaaaattacgtaaaactaccgtaggaacgtaccggaacgaacggaccgacggtactaagttagtaaacgtttacggtgggtttacgggtacgggttaacttaacgttttaaccggtacccggggtaacccccgggggttaccgggggaacccccggggttaaaccgttacccgggtacccctacccccggtttaccccctaacccccccgttaccccgaaccgg

SEQ ID NO: 416480 - DNA, 595 bp, Homo sapiens
  misc_feature: GZ8MTXP02F1BNB.22.85.H08.1.454.CMB.2.raw
  modified_base (508)..(508): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgttggggttcgtcagtggcgactacatgagcgtgggtccgcaggctccgaggggaaggccgtggagtggactctactacttattatagtggtcgtacacatactacacagcctccgtaggaacgggtacccgattacgaacctatcctaccaaagaaacgaacaaacttcccaaaggaaccaacgtaattgtaatacttaacaaaatgaaacttaacctgaacgagaccgaggacacggacatgtatacngtaggtgggctagtttacgtcgacccgtcgggggacccggaaccgtcggacctacccgtccctaccccacccctaccgtaaccccgg

SEQ ID NO: 416481 - DNA, 668 bp, Homo sapiens
  misc_feature: GZ8MTXP02JV8VM.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatggacgtcgtcggggtccccgccgacggccgtaccgaagggggtaacggggcccgtaggggaggtcgggattcctactaacgtttatttaagtggttgggtaccgtaacccacattacctacacagtaccgtccggtaggaacggggacctacttaccgaccatcctacgaaagaaacgaactaaacgttacccgaaaggtaaaccaacgtagtttagtacttactttaacaaagttagaaactaaaccgtgaacgacgccgaaaggacacggccagtggtattacgtggtaggtgggtactagtttacgccggaccccggtcgggggacccgggtaacctgggtaccccaccggtcccaccccccgacccgtacctaaaccccgg

SEQ ID NO: 416482 - DNA, 662 bp, Homo sapiens
  misc_feature: GZ8MTXP02JGK90.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccgagccgtgggggtccctgagactctcctgtgcagtctcgtgggttcgtcagtggcactacatgagcgtcgggtccgcaggctcgaggggaacggcctggagtggatctactacttattagtaggtggtcggtaccacactactacacagcgtccgtggaacgggccattaccacctatcctacgaagaagaactaacttaccgaagaaccactattagtactctttaaacaaattacggaaacttaaccgtagaacggaacgacccggaaggaccgaacggaccaagttacgttaacgttaacgttcggtagggtcgggggtacttacgtttaccgttaccgggaccccgggttacgggggtaccccggggaaacccggttcggtaccccgtaccccgggttaccctaccccccggtaccccgttaccccgaaaccccggg

SEQ ID NO: 416483 - DNA, 565 bp, Homo sapiens
  misc_feature: GZ8MTXP02JGV74.22.85.H08.1.454.CMB.2.raw
  modified_base (355)..(355): a, c, t, g, unknown or other
  modified_base (539)..(539): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtggggtgcagttggtggagactggaggaggcttgatccagcctgggggtccctgagactctcctgtgcagtctctgggttcgcagtggcgactacagtgagctgggtccgccaggcctccgaggggaaggcctgggagtggatcgtcactttatttatagtggtggtaccccanatactacacagactcgtgaacgggccattcaccatctacagtaagacaattcccgaagaacacattgtatctacaaatgaaatacctgagagcgacgacacgggcagtgtatacgtgtggtgggctaactttacgtcggtaccccgtcgggggacccgggtaaccctgggtcccaaccggtccncccccgaccctacccacgtaacccgg

SEQ ID NO: 416484 - DNA, 663 bp, Homo sapiens
  misc_feature: GZ8MTXP02HVQED.22.85.H08.1.454.CMB.2.raw
  modified_base (422)..(422): a, c, t, g, unknown or other
  modified_base (494)..(494): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttacaaaaggtgtccagtgtgaggtgctaggttgggtggagacgtgggaggaggcttgatccgagccggtgggggtccctgagctctctgtgcagtctgtggttcgtcagtgcgactacatggcgtcgtgggtccgccgaggccgtaccggaggggaacgggccgtagggagtggactctactaactttatttaagtaggttggtaccgtaccactactaacacacagccgtacgtaggaacggccgtataccacctntactacaagaaagaactaacttaccgaagaacctaactattagtattactaactaaatagtaaacttaacgngaaggacgaccggaacggacgaaccggacctaagttagttaacgttacggtgggttacgggttacggggtacttacggtttacccgtaccgggtccccgggtacgggggaccccgggtaaccgtcggtacccgaccccgtccctacccccgacccgtacccgaacccgg

SEQ ID NO: 416485 - DNA, 724 bp, Homo sapiens
  misc_feature: GZ8MTXP02I90CB.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttacaaaaggtgtccagtgtgaggtgctaggttggtggagacgtggaggagcttgatccaggccgtgggggtcctgagacttctcctgtcgctagtcttcgtgggttactcgtaggtggacgactacaagtcggaggtccggtcgggtcccgaccgaacggccgtaccgggacggggaacgggtccggtaggggtaggtacggacttccgttacgtactttaagtttacgtaggtttcggtaccggtacccaactacgttaacctacgacgaacgtaccgtccggtaacgggaacgggtacctacttaccaacctacgtaccgtacgaaagaacgtaaactaacttacccgaaaagtaccctaacttagtttacctaaattaccttaaactaaaaggtataaaactaacgtagaacggaaacgccgtaaacggacgaaccggctagtagttaatagtcggtaggtcggtacttaacgtttacggacccggtacccggcgggggttaccccgaacgtttcgacccttacccggacccctaccccgcctaacccgacccgg

SEQ ID NO: 416486 - DNA, 699 bp, Homo sapiens
  misc_feature: GZ8MTXP02H7FTV.22.85.H08.1.454.CMB.2.raw
  modified_base (254)..(254): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccaggccgtgggggtccctggagactctctgtgacngtctgtgggtcgtcagtggcgactacatgagcgtgggtccgccgaggcctccgaggggaacggccgtggagtggatctcgtacttaagtttagaggttcggtacggtaaccctaactagttaacctaactaacgacgacccttacgggtacggaaacgggggtccctaaatttccccaactacgaccttaccaaagtaaacgaacaaacttccgaaacgggaaacacctaagttactacttaacttaactaaatagtaaactaaaccgttagaaggacgaaccggaaggaaccacggggacctagtacgtaagttaaccgtggtggtacggggtacttaacgtttacgttccggtaaaccccggtccgggggtaccccggggtaacccgttacgggacctacccccggtccctaccccccggtaccctaccccgaaacccccggg

SEQ ID NO: 416487 - DNA, 624 bp, Homo sapiens
  misc_feature: GZ8MTXP02FUEQQ.22.85.H08.1.454.CMB.2.raw
  modified_base (368)..(368): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtggagacgtggaggaggcttgatccaggccgtggggggtccctggagactctcctgtgcagtctcgtgggttcgtcaggtggcgactacatggacgtcgtgggtccgccgaggctaccgaggggaacggcctgggagtggatctctatttattataggtggtcgtaccanatactacacagctccgtagaacgggcctattccaacctatcctacaagaacgaactaaacttaccgaaggaaccactagttagtattacttacaaatagaaactaacctagaacgacgaccgaggacacggacagtacgtattacgtggtcggtggggtacttaacgtttacgtacggtaccccggtcgggggtaccccgggaaccgttcgggtccctacccggtccctacccccgacccgtacccgaaaccccgg

SEQ ID NO: 416488 - DNA, 683 bp, Homo sapiens
  misc_feature: GZ8MTXP02G1GFV.22.85.H08.1.454.CMB.2.raw
  modified_base (431)..(431): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactgggaggaggcttggatccgagccgtgggggtccctgagtactctcctgtgcagtctcgtgggtcgtcagtggcactacatggagcgtcgggtcccgccagggcctaccggaaggggaacgggcctagggaggtgggacttcgtactacgttttatttagtagtcggtcggtaccacatactaacacaacgctccgtaggaaacgggcctaattcaacctatcctanaacgaaagactaacttacccgaagaaaccatatttagtatcttaaacaaagtagtaaaacttaaaccgtgaaaggaacgacccgggaagaaccgacgggtacccaagttacgttaaagttaaccgttgggtaggtacgggggtactaagttttaaccgtaccgggtaacccccggtggggggaacccccggtaaccgtcgggtacccgtaaccccggtcctccccccgttaacccccgacgtaaacccccgg

SEQ ID NO: 416489 - DNA, 711 bp, Homo sapiens
  misc_feature: GZ8MTXP02H81JK.22.85.H08.1.454.CMB.2.raw
  modified_base (558)..(558): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagactgggaggaggcttgatccgagccggtgggggtccctgagtactctcctgtgctagtctcgtgggttcgtcaggtcggcgactacgatgaggcgtcggggtccccgccgacggccgtccggaaggggaacggggccgtgggtaggtcggtaagttcctacgttacttttaagttttaagtaggtcgggttaccggtaaccctaactaactaaccgtactaacgacggtacctccgggttaaggaaaccgggggtccctagttaccaacctatcctacgaaagaaacgtactaaactacccgaaggtaaactacgtagttacttaacttctaaactaaattaggaaaacttaaccgnggaacggaacgaccggaaggaccgacggcctaagtagtaacgttacgtggtagggttccgggtattacgtttacggtcccggtaccccgggtggggaccccgggtaaccgtcgtacccgaccgtccccacccccgtacccacccgaaccccgg

SEQ ID NO: 416490 - DNA, 650 bp, Homo sapiens
  misc_feature: GZ8MTXP02H3AHI.22.85.H08.1.454.CMB.2.raw
  modified_base (420)..(420): a, c, t, g, unknown or other
  modified_base (425)..(425): a, c, t, g, unknown or other
  modified_base (432)..(432): a, c, t, g, unknown or other
  modified_base (472)..(472): a, c, t, g, unknown or other
  modified_base (480)..(480): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagacgtgggaggaggcttgatccaggccggtgggggtccctgagactctcctgtgcagtctcgtgggttcgtcgagtcggcgactacatgagcgtcgggtccgccgacggcctccggaggggaacgggtccgtagggacggtggacttcgtactactttatttagtaggttggtcgtaccactataactacacagccgtcggaggacgggccattcactntctanaaggaanactaacttaccgaaggaacctatattacgtatccttaaanaaattaanaacttaaaccgtggaacgacgtaccgaaggacgtacgactagtagtacttacgtggtacgggtcgggtactacgtttacctaccgggtaccccgtcggggggaccccggtaacccgtcgggttaccctacccggtccccgtaccccccgtacccgtaccccgaaacccgg

SEQ ID NO: 416491 - DNA, 645 bp, Homo sapiens
  misc_feature: GZ8MTXP02JNP0M.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttctcgaggtggcgactacagtgacgcgtgggtcccgccgaggctaccggaggggaacggccgtggagtgactctactactttatttagtagtggtaccgtacacataaccgtacacacgtccgtccgtaggaaacgggtccgattaccgacctacgtctacgaagaacgaacgtaattacccgaaagaaccataacgttgtacttacgttaacaaatacgtaaactaaccgtgaaggacaccggaggaccacggactagtacgttatacgtaggtggtacgggcttaagtttccgtacggtacccccggtcgggggaccccgggtaacccgttcgggacccctacccgtccccacccccgtaccccgtacccgaaacccgg

SEQ ID NO: 416492 - DNA, 593 bp, Homo sapiens
  misc_feature: GZ8MTXP02IT28Y.22.85.H08.1.454.CMB.2.raw
  modified_base (356)..(356): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaacgggcctggagtggatctctacttattataggtggtcgtaccanatactacacagctccgtaggaaacgggccgattccaccatcctacagaagacaattccaaggaaccatattagtactcttacaaatagaaacttaaccagtaagagaccgaggaaccacgggaccatagtattactgtggtcggggtactagtttacgttacgtacccggtcgggggacccgggtaacccgtcggtacctacccggtccctacccccaccccgtacccaaaccccgg

SEQ ID NO: 416493 - DNA, 684 bp, Homo sapiens
  misc_feature: GZ8MTXP02G6NCB.22.85.H08.1.454.CMB.2.raw
  modified_base (295)..(295): a, c, t, g, unknown or other
  modified_base (501)..(501): a, c, t, g, unknown or other
tcagacatacgcgtcacgaccggtgctcgatttagtatcactcagtcggcggggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccnccgaggctccgaggggaaggccgtggacgtggactctactactttattagtaggtggtacggtacccacatacctaacgacacgtacctccgtaggaacgggcccgtaattcaacctaatcctacaaagaaacgaaactaacttacccgaaggaaaccaactaattgtaaacttcttaaactaaaagtaggtaaaacttaaaccgnggaaacggacgaaccgaacggaacgtaaccgggtacccaattagtaacgttaacgtggttaggtcggggtaacctagtttaaccgtccggaacccccggtcggggggtaccccggggtaaaccccgtggggttacccccaaccggttcccctaccccccgtaaccccttccccgaaaacccgg

SEQ ID NO: 416494 - DNA, 738 bp, Homo sapiens
  misc_feature: GZ8MTXP02I39BG.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcgagtggcgactacatgacgcgtcggggtccccgcgtaggcctcccgaagggggaacgggtcccgttaggggaaggtgggtaacttccttacgtaaccttttaattttaagtaagggttgggttacggttaaccctaacgtaacttaacctaaccaaaccgacgtaccggttaccccgttaggaaaacgggggacccgtaagtttacccaaccctaattaccctacgaaagtaaaacgaactaaactttacccgaacggaaaccacgtaaattttgtaaacttcttaaacgaaataacggtaaacttaaacccgtggaacggaacgccgggaaagacccgacgggacctagttacgtattaccgtagttgggtcggggtactacgttttacgtaccggaccccggtacgggggacccggtaaccgtcggttacccgaccggttccccttaccccgaccccttacgaaaccccgg

SEQ ID NO: 416495 - DNA, 805 bp, Homo sapiens
  misc_feature: GZ8MTXP02G38TJ.22.85.H08.1.454.CMB.2.raw
  modified_base (305)..(305): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagcttgggttttccttgttgcttatttacaaaaggtgtccagtgtgaggtgctaggttggtggagacgtgggaggaggcttgactccaggtcccggtcggggggtccctagacgtacctctcctgtcgctagtctcggttgggttcgtcgaggtggcactacngtgagtcgtcggcccgcgacggctcggaggggaggccgtggagtggactcttactactttatttacgtaggttcggtacgtaacccactaactacctactaacgacgtaccgttaccgggtaggaaccggggtacctaacgtttacccgacctacgtacctaacggaaacgtaaaacggaacttaaaccttacccggaaaacggtaaacctacgttaaacgtttaacgttaaacctttactttaaaaccaaaacgtttaaacggtaaaaccttttaaacccgtaaagggaacgggtaacccgggaacccggtaaaccgggaaccgaaccgggtactaacgtttacggttaacgtttacggttagggtacgggttggggtaactttaacggtttaccggtacccgggttaaccccggggaccgggggttacccggtaacccggtaccggttacccgtaccccgttacccctacccccggaccccttacccggaaaccccgg

SEQ ID NO: 416496 - DNA, 572 bp, Homo sapiens
  misc_feature: GZ8MTXP02IUWA3.22.85.H08.1.454.CMB.2.raw
  modified_base (349)..(349): a, c, t, g, unknown or other
  modified_base (370)..(370): a, c, t, g, unknown or other
  modified_base (374)..(374): a, c, t, g, unknown or other
  modified_base (404)..(404): a, c, t, g, unknown or other
  modified_base (421)..(421): a, c, t, g, unknown or other
  modified_base (547)..(547): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtcagtgtgaggtgcagttggtggagacgtggaggaggcttgatccagccgtcgggggtcctgacgactctcctgtgctagtctcgttgggttcgtcgaggtcggcgactacatgagcgtcggtccgcgaggctacggagggacggccgtggagtggatctctacttatttagnggtgtacgtaccacatactanacanccgtcgagacggctatcacatcacagaacncaaactccgaagaaccngtaatagtactcttaaacaaatagtaaaactaccgtagaggtaaccgcgaacggacgaacggctagttacgtatcgtgtggtggtactagtttcgtacgacccggtcggggaccgtcgtcgtaccnccgtccctcccacccgtacaaccgg

SEQ ID NO: 416497 - DNA, 770 bp, Homo sapiens
  misc_feature: GZ8MTXP02IOGJG.22.85.H08.1.454.CMB.2.raw
  modified_base (389)..(389): a, c, t, g, unknown or other
  modified_base (490)..(490): a, c, t, g, unknown or other
  modified_base (563)..(563): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgagactctcctgtgcagtctcgttgggttcgtcaggtcggcgactacatgacgtcgtcgggtccgccgaggcgtaccgaggggaacggccgtagggaggtggacttcgtctactttatttagtaggtggtacgtaccacatactacacganccgtcgagacggctacttcacctatcctacgaaagaaacgtaaactaacgttaccgaaagaaaccgtaacttaagttttacgtaaactttaccctttaaanaaaaaacgtttacggtaaaaaccttaaacccgttagggtaaacggaaaccggaacccggaaccggggaaaccnccgggggtaaaccctaaacggtttaggtttaaaaccttggtttccgggttagggttaccgggggtacttttaaacgttttaaccccggttcgggtaaaccccccggggttacggggggtaccccggggttaacccccgttacgggttacccccgtaaaccccggttcccctacccccccgtaaccccgtccccgtaaaacccccggg

SEQ ID NO: 416498 - DNA, 871 bp, Homo sapiens
  misc_feature: GZ8MTXP02HVPY5.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccaggccgtgggggtccctgagctctcctgtgcagtctcgtgggttcgtcaggtggcgactacatgagcgtcggggtcccgccgaggccgtaccggacgggggaacggggccgtaggggacggttagggacttacctacttaaccttttaagtttttaagtagggttacggggttaccgggtaaacccctaacgtaaacttaaccttaaaccaaccgtaagtacccgttccgggttaacgggaaaccgggggtacccccgtaatttacccgaaacccttaagtacccgttacgaaacggaaaagtaaaccgtaaactttaaccccgaaacgggaaacctaaccgtaattttaggtaactttacctttaaacgaaaattaacggtaaaaacttaaacccgttagggaaacgggtaacggacccggaaacgggaaccgaacccgggtaccctaaagttaccggttaaaacgtttaacgttcggggttagggggtttacgggggtaacctttaaacggtttttaacccgttaccgggtaccccccgggggttacggggggtaacccccgggggtaaaccccgtttccggggtaccccgtaccccgggttacccccgttaaccccccctacccccgttaccccgaaaacccccggg

SEQ ID NO: 416499 - DNA, 751 bp, Homo sapiens
  misc_feature: GZ8MTXP02J0M47.22.85.H08.1.454.CMB.2.raw
  modified_base (354)..(354): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtggggggtccctgagactctcctgtgcagtctcgtgggttcgtcaggtggcgactacatgagctgggtccgccaggcctccgaggggaaggcctggagtggatctcacttatttataggtggtcgtaccanatactacacagacctccgtaggaaacgggccgattccaaaccctataccctacgaaaggaaacgaacctaaacttacccgaaacggggtaaacccaacctaacgtttagttaacttaccgtttaaaccctaaaagttacggtaaaacttaaaccccgttaggaacggtaacggacccggtaaacggggaacccgaaccgggggacccctaagttacgttaaacgtttaaccggttcggttaggggttcggggggtacttaaacggttttaacccgttacgggtaacccccccggttaggggggtacccccgggggtaaaccccgttcgggggtacccgtaacccccggttcccccgtaccccccgtaacccccggttaccccgtaaaccccccgggg

SEQ ID NO: 416500 - DNA, 731 bp, Homo sapiens
  misc_feature: GZ8MTXP02HQ9ZV.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccaggccgtgggggtccctgacgactctcctgtcgcagtctcgtgggttcgtcgagtggcgactacatgagcgtggtccgccgaggcctccgaggggaacggccgtggaggtggatcgtactactttatttagtaggtggtaccggtaccactatacctacaccgagtccgtaccggtagaacgggccgtattccacctactccgtacaacgaacgaactaacgtttcccgaaaggtaaaccacgttactttagtaacttcgttaaactaaacgttaacgaaacgttaaccgtagaaccgggtaacgacccggtaaacggacccgtaaccgggtaccgttaagttacggttaactttaaccgttagggtttacgggttacgggggtacctttaaacgttttaccgttacccgggtaccccggttacccggggggaccccggttaaacccggttcggtaaccccgtccccgttaccccgtaccccccgttaccccgtaccccgtaaaccccggg

SEQ ID NO: 416501 - DNA, 740 bp, Homo sapiens
  misc_feature: GZ8MTXP02G49C3.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccaggccgtgggggtcctgacgactctcctgtgcagtctcgtgggttcgtcagtggcgactacatgagcgtcgggtcccgccgaggccgtccggaggggaacgggccgtagggaggtggactcgtactactttatttagtaggttggtacggtaccactaactactacaacgtacgccgtaccgtaggaaacgggtccgtattaccacctatcctacgaaagaaacgaactaaacttacccgaaaggaaaccaacttaagtttacgttaacttacctttaaaacctaaaattaacgtaaaaccgttaaaccgtagggaaacgggaaccggacccggaaaacgggacccgaaccgggtaccctaagttacgtttaaacgttacgttacgggtaggggtacggggtactttaacgttttaaccggtcccgggacccccggggttacgggggaccccggggtaacccgttcggggtacccctacccggtcccctaccccccggacccctacccgaaaccccgg

SEQ ID NO: 416502 - DNA, 635 bp, Homo sapiens
  misc_feature: GZ8MTXP02FK369.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgttgggttcgtcaggtggcgactacatgagcgtgggtccgcaggctccgaggggaggcctgggagtggatctacgtactttagttagtaggtggtacgtaccactatactacacagctccggaggaacggccgattaccgactatctcaagaagactaacgttcccgaaggaaccacgtattcgtattcttaacaaatgaaactaccgtagaggtaacgccgaaggaccacggtaccagtacgttagttaacgtggtggtaggggtactacgttttaccgtacggtacccccggtgggggtacccccgggtaaacccgttcggtaccccgtaccccggttccctacccccgtaccccgttacccgtaaaacccccggg

SEQ ID NO: 416503 - DNA, 762 bp, Homo sapiens
  misc_feature: GZ8MTXP02GAXEV.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggtttccttgttgctatttcaaaggtgtccagtgtgaggtgcagttggtggagactggaggaggcttgatccagccgtgggggtccctgagactctcctgtgcagtctcgtgggttcgtcagtggcgactacatgagcgtgggtccgcgaggcctccgaggggacggcctgggagtggactctctacttattataggtggtacgtaccactagtacctacaacgagaccgtccgtaggaaacgggtcccgtaattccgaaaccgtattaccctagaaaacggaacgtaaacctaaagttaccccgaaggaaacccctaagtacgtttagtaacttacctttaaacaaaagttcggtaaaacttaacccgtaggtaacgggaaaccgaccccgggtaaagggaaaccctaccggggaacccttaaggttacgttaaacgttttaccgtaggggtttacggttacgggggtcctttaaaaccgttttaccggttaaccggtaaaccccccggggttcggggggtaacccccgggggtaaaacccccgttcggggtttaacccccgaacccccggtttcccgttacccccccggaaccccttacccccggaaaaccccgg

SEQ ID NO: 416504 - DNA, 639 bp, Homo sapiens
  misc_feature: GZ8MTXP02FS2FD.22.85.H08.1.454.CMB.2.raw
  modified_base (299)..(299): a, c, t, g, unknown or other
  modified_base (464)..(464): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagttctcgtgggttctcgagtcggcgactacatgagcgtcgggtccnccgaggctccggagggacggccgtggagtggactctactacttattagtagtggtcgtaaccacatactacaacacgtcgtaccgtaggaacgggtccgtattacacctatctacgaagaaagtacaagttccgaaagaacctagtacttgaaacttctttaaanaaatagtaaacttaaccgagaagacggacccgaaggaccgacggtactatacgtttagtacgtggtggtagggtccttaaagtttccgtaccggtacccggttcgggggaccccgggtaaacccgtcgggtaccctacccggttccccaaccccctacccgttcccaaacccggg

SEQ ID NO: 416505 - DNA, 885 bp, Homo sapiens
  misc_feature: GZ8MTXP02JENXT.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggtagttttggctgagtcttgggttttccttgttgcttatttcaaaaggtgtccagtgtgaggtgctagttggtggagacgtgggaggaggcttgatccgaggccgtgggggtccctgagactctcctgtgctagttctcgtgggttctcaggtcggcactacagtgagcgtcgggtccgccgaggcctacggaggggacgggccgtgggagtggactcgtctatttattagtacggtggtaccgtaacacgtaactacgtacaacgtacgaccgttcggtacgggaacgggaccgtaacttccgtaaacctcgtaaccgtacgaaaacggtaaaggtaaacccttaacggtttaaccccggggaaaaactcccgttaaagtttaccggttaaactttacctttaaaaccgtaaaaaggtttacgtaaaaacccggtttaaaaccctaggggtaacgggtaaaaccgaacccggggaaacggggtaaacccgaacccggggtaaccttacgggttaacggtttaaactttacccggtaaggggtttcgggggttaccgggggttaacctttaaaccggtttttaaacccgggtttccccgggggaaacccccggggtttccgggggggggtaaaccccgggggtttaaaccccccgttcgggggttaccccccttaaacccccggggttcccccctttaacccccccgggaaacccccctttaccccgggggaaacccccggtaaaacccccggggg

SEQ ID NO: 416506 - DNA, 613 bp, Homo sapiens
  misc_feature: GZ8MTXP02I81LV.22.85.H08.1.454.CMB.2.raw
  modified_base (410)..(410): a, c, t, g, unknown or other
  modified_base (457)..(457): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgtcagtggcgactacatgagcgtcgggtcccgccgtaggcctccggaaggggaacgggcctgggaggtggatcctactacttatttataggtggtccggtaccacgatacctacacagtcgtaccgtgaacgggccgattacacctnactacaagaacgaacaattacccgaagacaacgtattgtatccttanaaatagaaactaactgaagagccgaggacacggacagtagtacgttactggttagtggggacttacgttacgttcggaccccggtcgggggtacccggtaacccggttcgacccggtacccgttccccgaccccctacccttacccgaaaccccgg

SEQ ID NO: 416507 - DNA, 644 bp, Homo sapiens
  misc_feature: GZ8MTXP02JV4BE.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccaggccgtgggggtcctgagactctcctgtgctagtctcgttgggttcgtcgaggtggcgactacatgagcgtcgggtcccgccgaggcctccggaggggacggccgtggagtggatctactactttatttagtagtggtacgtaccacatacctacacacgtctccgtaggacgggccattcccacatctacaagaacgactaactacccgaagtaaccactattagtactacgttaacaaatacggaaacttaccgagacgaacgccgaacggaccacggactagtagtacttacgtggtacggtggggtcttaaggtttccgtaccgaccccggggttcgggggaccccggggtaacccttcggggtaaccccgtacccggttaccccctaccccccgtaccccgacccgtaaaccccggg

SEQ ID NO: 416508 - DNA, 591 bp, Homo sapiens
  misc_feature: GZ8MTXP02JQMZP.22.85.H08.1.454.CMB.2.raw
  modified_base (310)..(310): a, c, t, g, unknown or other
  modified_base (417)..(417): a, c, t, g, unknown or other
  modified_base (425)..(425): a, c, t, g, unknown or other
  modified_base (438)..(438): a, c, t, g, unknown or other
  modified_base (460)..(460): a, c, t, g, unknown or other
tcagacatacgcgtcacgaccggtgctcgatttagtatcactcagtcggcggggggagaggagcccagcactgggattccgaggtgtttccattcggtgatcagcactgaacacagaggactcaccatggagttttggctgagcttgggtttccttgttgctagtttcaaaaggtgtccagtgtgaggtgcagttggtggagactggaggaggcttgactccagccggtcggggggtccctggacgtacctcgtcctgtcgcagtctcgtcggttcgtcgagtcggcgactacatgagccgtgggtcccnccgaggcctaccgaggggacggcctggacgtggactcgtctactttatttagtaggttggtacggtaccatatactacacagacctccgaggacggcctatcactanctcaaganacatccgagacanatgatctacaatagaacttacngagacgaccgaaggactacggctagtgtaaattcgtggtggtgggacctagtttacgtccggacccggttgggggaccccggtaaccgtggtaccgtacccggtccctcccccgaacccgtccaaccccgg

SEQ ID NO: 416509 - DNA, 566 bp, Homo sapiens
  misc_feature: GZ8MTXP02HQO7W.22.85.H08.1.454.CMB.2.raw
  modified_base (352)..(352): a, c, t, g, unknown or other
  modified_base (445)..(445): a, c, t, g, unknown or other
  modified_base (485)..(485): a, c, t, g, unknown or other
  modified_base (510)..(510): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtccctgagactctcctgtgcagtctcgtgggttcgtcaggtgcgatacatgagctggtccgccaggctccgaggggaggcctggagtggatctctactttattagtagtggtcgtaccanatactacacgagcctcggtgaaacggggtcctaattccactaactccagacgaaagaacaattcccaaaggtaaccatattgactctataaangtaaaattaccgtgaagacgaccgagggactaacgcagtntactagtgtggtgggactatttacncgacccgtggggaccggtaacctggtccgaccgtccctccccgaccttcaacccgg

SEQ ID NO: 416510 - DNA, 495 bp, Homo sapiens
  misc_feature: GZ8MTXP02FVJ7J.22.85.H08.1.454.CMB.2.raw
  modified_base (229)..(229): a, c, t, g, unknown or other
  modified_base (310)..(310): a, c, t, g, unknown or other
  modified_base (315)..(315): a, c, t, g, unknown or other
  modified_base (471)..(495): a, c, t, g, unknown or other
tcagacatacgcgtcacgaccggtgctcgatttagtatcactcagtcgcgggcaggctccagggaagggcctggagtggatctcacttatttatagtggtggtaccacatactacacagactccgtgaagggccgattcaccatctcagaagacaattccaggaacacattgtatcttcaaatgaaataacctgagagccgagacacggccatgtattactgtgtgggntatttactgaccccgtggggcccgggaacctggtcaccgtcctccccaccctccaccgaggcccatccggtccttcccccncgccnccctcctccagcgccacctcgtcgggggcacgacggccggcccgtgggcctcggccgtcggtacccgaacggtacctaccgttaccgaccgtccggttagttcgtcgtacgggacgggtccggggcgttacggggaccgaacgggcgacgagtagnnnnnnnnnnnnnnnnnnnnnnnnn

SEQ ID NO: 416511 - DNA, 823 bp, Homo sapiens
  misc_feature: GZ8MTXP02G631L.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgtgggttcgtcgagtggcgactacagtgagtcgtcgggtcccgcgacggccgtaccggaggggaacgggccgtagggaggtggacttcctactacgtttaatttaagtaggttcggttaccggtaaccctaactaacttaacctaacgaaaccgtaacggtacccgtaccgggtaacgggtaaaccgggggtaccccgtaaactttaccccgaaacccgtaaacttacccgttaaaccgaaaacggtaaaacgtaaaccctaaaacgttaacccgaaaacgggtaaaaccctaaacgttagttttaacgtaactttaccttaaaacgtaaaattaaacgtaaaacttaaaccggtaaggaacggtaacggaacccggaaacggaaccgtaaccggacctaagttacgttaaattaaccggtggttacgggtacggggttctttaaacggtttaccgttacccgggaaacccccggggtttgggggaacccccggggtaaacccgttcgggtacccctaaccccggttccccctaccccccgtacccgtacccgaaacccccgg

SEQ ID NO: 416512 - DNA, 605 bp, Homo sapiens
  misc_feature: GZ8MTXP02I4OLO.22.85.H08.1.454.CMB.2.raw
  modified_base (357)..(357): a, c, t, g, unknown or other
  modified_base (382)..(382): a, c, t, g, unknown or other
  modified_base (384)..(384): a, c, t, g, unknown or other
  modified_base (407)..(407): a, c, t, g, unknown or other
  modified_base (411)..(411): a, c, t, g, unknown or other
  modified_base (440)..(440): a, c, t, g, unknown or other
  modified_base (455)..(455): a, c, t, g, unknown or other
  modified_base (472)..(472): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggtcttgactccgaggtccgggtcgggggtcctgacgtactctcgtgtgctcgtctcgttgggttctgacggtgacgactagatgacgcggtcggtcccgcgacgccgtacggaggacggcgtggagtgactctctatttattagngttaggtcgtaccatatactacacncncgtccgaggacggctactcactntacngaaagaacactacacgaaagacctaagtnttagtactacttaanaaagttagaactaacgngacgacgaccgagaacgcgactagttagtaactttgtaggtcggtaaggtctttaagtttcccgacgggacccggtacggggacccgtcggtcctaccgtaaccccgtcccaccccgtaccgacccgtaaccg

SEQ ID NO: 416513 - DNA, 576 bp, Homo sapiens
  misc_feature: GZ8MTXP02HRXCW.22.85.H08.1.454.CMB.2.raw
  modified_base (330)..(330): a, c, t, g, unknown or other
  modified_base (362)..(362): a, c, t, g, unknown or other
  modified_base (391)..(391): a, c, t, g, unknown or other
  modified_base (401)..(401): a, c, t, g, unknown or other
  modified_base (413)..(413): a, c, t, g, unknown or other
  modified_base (445)..(445): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggagcttgatccagccgtgggggtccctgagactctcctgtgcagtctgtggtctcagtggcgacacagtgagctcgggtccgccaggcctaccgaggggaacggccgtggagtggatctanactttatttagagtggtcgtaccatataccanacgagctcgtagaacgggcctatcactanctagagaaanactactacgaanacatattatatactaataaatataaactaagngaagacgacgacgacgacgtactatagtacttagtgtacgggtagtacttacgttacgtaccggtaccccggtacggggacccggtaaccgtcggtacccgtacccgtccctaccccaccctaccgaaccg

SEQ ID NO: 416514 - DNA, 704 bp, Homo sapiens
  misc_feature: GZ8MTXP02JNL2C.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtggggtgcgagttggtggagacgtgggaggaggtcttgatccgagccgtgggggtccctgagactctctgtgcagtctcgttgggttcgtcgaggtcggcgactacatggacgcgtcgggtccgaccgaggcctaccggaaggggaacggccgtagggacgtggacttcgtaccgtaacttttagtttaagttaggttacgggttacggtaaccccctaactaacgtactaacacgaacggtaaccctccgggttaagggaacgggtacccggtacttacccgtaaccgtactacccttaacgaaaggtaaaacctaaccgtaaaacgttcccgaaaacgggaaactacccgtatttaagtacttacccttaagtaaaatacgtaaaactaccgtaggaacgacggacgaacgacacggctatcgtattacggtgtagggcggtcttaaagttccgtacgcccggggtagggccccggtaactcgacccgacccgttcccacccaccccgtcaccggaaccg

SEQ ID NO: 416515 - DNA, 659 bp, Homo sapiens
  misc_feature: GZ8MTXP02I5ZAV.22.85.H08.1.454.CMB.2.raw
  modified_base (271)..(271): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaggtgtccagtgtgaggtgcaggttggtggagacgtggaggaggcttgatccgagccgtgggggtcctgagactctccgtgtgcagtctcgtgggtcgtacgngtggcgactacatcgagcgttcggccgccgacggctccggaggggaaggcccgtgggaggtgacttcgtactactttaagttagtggtcggtaccggtaaccacgtataccgtacaacgacgtacgtcggagaaacggggccaagttccacgtactctacgaagaacgaactaacgttaccgaaggaacaacttagttaatactacttaacaaataaggtaactacgtagaagacgaccggagtacgaccgtacgtgtacgtacgttacgtcggttgggtaggtcttaaagtttccgttacccgggaacccgggtcgggggtaacccccggggtaaccgttccgtaccggtaccccgtccctaccccggtacccctaccgaaccccgg

SEQ ID NO: 416516 - DNA, 748 bp, Homo sapiens
  misc_feature: GZ8MTXP02HJ9ME.22.85.H08.1.454.CMB.2.raw
  modified_base (299)..(299): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagactggaggaggcttgatccagccgtgggggtcctgagactctcctgtgcagtctcgtgggtcgtcagtcggcgactacagtgagcgtggggtcccnccgaggcctccggaaggggaacgggtccgtaggggagtgggacttcctactactttaatttagtaggttggtaccggtaccaacataacctaacacgagtacctccggtagaaacggtccgaattccaactatctacgaaggaaacacgtaaacttacccgaaaggaaacctaacgtaacttagttaacttactttaaacctaaaagttaaggtaaaacttaaaccgtaaggaacggaaccggaccggtaacggaaccgaaccgggaccctaacgttagttaaacgttaaccggtttcggtaacgggttgggggtacctaacgttttaaacccgtttccggaacccccgggtttacggggggaccccgggggtaaaaccccgttcgggttaaccccgtaaccccgtacccggtaccccccctaaccccggttaccccaaaaccccgggg

SEQ ID NO: 416517 - DNA, 634 bp, Homo sapiens
  misc_feature: GZ8MTXP02FOKZ7.22.85.H08.1.454.CMB.2.raw
  modified_base (250)..(250): a, c, t, g, unknown or other
  modified_base (294)..(294): a, c, t, g, unknown or other
  modified_base (389)..(389): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggagcttgatccagccgtgggggtcctgagactctcctgtgcngtctcgtgggttcgtcaggtggcgactacatgagcgtgggtccncgaggctcgagggaggctggagtggatctctacttattagtagtggtcgtaccacatactacacagctaccgtgaacgggccattcaccgatctnaagaagacaattacaaggacatacgttatatcttacaaatagtaaactaaccgtagaacggagacccgaaggaccacgggtaccaagttagtaaacgtttacgtacgggttggtacgggggttacttaacgttttaccgttacccggtacccccggggtacgggggtacccccggggtaaaccgttccgggggtacccctacccgggtccctaccccccgttaccccacccgtaaaacccccggg

SEQ ID NO: 416518 - DNA, 755 bp, Homo sapiens
  misc_feature: GZ8MTXP02JKYAV.22.85.H08.1.454.CMB.2.raw
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcttgggttttccttgttgctatttcaaaaggtgtaccagtgtgaggtgcagttggtggagacgtgggaggaggtcttgactccgaggcccggttggggggtccctggacgtactccgtccgtgtgcgtagtcctcgttgggttcgtcgagtcggacgtaactacagtgacgtcgtcgggtcccgcgacggccgtaccggaggggaacgggccgtagggaggtacggacttcctacttaactttagtttaagtaggttcggtaaccggtacccaactaacgtaacctacaacgtaacgaccgttccggtaaggaaaccggggtcctaacttacccaaccgtacttaccgtaacgaaacggaaacgtaaactaaaccgtttaacccgaaacggtaaaccaacgttaagttacgttaacttacttaaacaaaagttacgaaaacttaaccgtaggaacggaccgaccggaagacccgaacggactagttagtacttacggtggtacgggtagggtaccttaaacgtttccgtaccggaccccggggtacgggggaccccggtaaccgttcggaccctacccggccccttacccccgacccgtaacccgtaacccgg

SEQ ID NO: 416519 - DNA, 591 bp, Homo sapiens
  misc_feature: GZ8MTXP02GGB04.22.85.H08.1.454.CMB.2.raw
  modified_base (362)..(362): a, c, t, g, unknown or other
  modified_base (389)..(389): a, c, t, g, unknown or other
  modified_base (398)..(398): a, c, t, g, unknown or other
  modified_base (403)..(403): a, c, t, g, unknown or other
  modified_base (415)..(415): a, c, t, g, unknown or other
  modified_base (421)..(421): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgacgcgtcgggtccgccaggcctccgaggggaagggcctggagtggatctcgtactttattagtagtggtggtacccanactacacacagctcgtaggaaggccgntacacatcncaganacatacagacanagttanatctacaaatgtaaatactcgagtacgaccggaagacgacggacctagtagttaacttacgtgtacggtggggtaccttagtttacgtccgacccggtcgggggtacccggtaaacccggtcggtaacccgtccccggtccctacccccgtacccgtaccccaaacccgg

SEQ ID NO: 416520 - DNA, 576 bp, Homo sapiens
  misc_feature: GZ8MTXP02F8W3L.22.85.H08.1.454.CMB.2.raw
  modified_base (324)..(324): a, c, t, g, unknown or other
  modified_base (348)..(348): a, c, t, g, unknown or other
  modified_base (388)..(388): a, c, t, g, unknown or other
  modified_base (480)..(480): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctcaggggaaggcctggagtgatcgtnacttattatagtggtcggtaccanatactacacagctccgtgaacgggccgattcaccatcctnaagaacgaactaacttccgaaggaaccacattagactcttacaaattgaaactaacctgaacgagaccgaaggacacggccagtgtattacnggtacgtgggactatttaacgtcgaccccgttgggggaccccgggtaacccgttgggtacccacccggtcctacccccgacccttccaaaccccgg

SEQ ID NO: 416521 - DNA, 640 bp, Homo sapiens
  misc_feature: GZ8MTXP02G2NVZ.22.85.H08.1.454.CMB.2.raw
  modified_base (344)..(344): a, c, t, g, unknown or other
  modified_base (478)..(478): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatcgtagccgtgggggtcctgagactctcctgtgctagtctcgtgggttcgtcgaggtgggacgactacagtgagtcgtcgggtcccgccgaggcctaccggaggggaacggccgtggagtggatctntactttattagtaggtgtaccggtacactatactacacgacgtacctccggtaggaacgggccgtaattaccacctatcctacgaagaaagacctaagttaccgaaggaacctactaattagtacttacctaanaaatacgtaaataccgtagacgtacgaccgagtaccacggctagtagtacttgtaggtgggtacggtacttacgtttacggtccgaccccgggttgggggtaccccgggtaaccgttcggaccctacccggtccctaccccccgacccttcccgaaacccgg

SEQ ID NO: 416522 - DNA, 553 bp, Homo sapiens
  misc_feature: GZ8MTXP02FHUC5.22.85.H08.1.454.CMB.2.raw
  modified_base (364)..(364): a, c, t, g, unknown or other
  modified_base (432)..(432): a, c, t, g, unknown or other
  modified_base (489)..(489): a, c, t, g, unknown or other
  modified_base (509)..(509): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctggggttctcgagtggcgactacgatgagctggggtccgccaggcctaccgaggggaacgggccttaggacggtggatctactacttatttatagtggtcggtaccanatactcaacagacctccggtagaagggccgattcgacccatactcagaagactaactaccaggaacanattgtatcttaacaatagaataacctgagagcccgagacacgcatgtatactgtcgngggtctattactcgacccgnggaccggaacccgtgtaccaccgtcctccccaccctccgaaccg

SEQ ID NO: 416523 - DNA, 766 bp, Homo sapiens
  misc_feature: GZ8MTXP02FPVJU.22.85.H08.1.454.CMB.2.raw
  modified_base (239)..(239): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgctaggttggtggagactggaggaggcttgatccagccgtgggggtcctgngactctcctgtgcagtctcgtggggttctcaggtggtagactacgatggagcgttggggtcccgccgaggcctccgaggggacgggccgtgggagtgggatcgtcgtacttttattagtaggttggtccgtaaccacagtactacaacgtacgccgtccggtaggaaacgggccgtaattccgaaaccctatcctacaaaggtaaacgaactaaacgttacccgaaacggtaaactaacgttaagtttacgttaaacttcctttaaaccaaaagttaacggtaaaacttaaaccccgtagggtaaccgggaaacggtacccgggaaacgggaacccgaaacccgggtacctaaggtttacgttaaacgtttaccgttacgggttagggtacgggggttacttaacggtttttaaccgtccgggtaacccccgggtccgggggtaaccccgggggtaacccgtcggggtaccccgtaccccggttcccccgtacccccccgtaaccccgtaccccgtaaacccccggg

SEQ ID NO: 416524 - DNA, 701 bp, Homo sapiens
  misc_feature: GZ8MTXP02IPSB4.22.85.H08.1.454.CMB.2.raw
  modified_base (267)..(267): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctggagactctcctgtgcagtctcgtgggttcncgagtggcgactacatgagtcgtcgggtccgaccgaggcctccggaaggggacgggccgtgggagtggatctactactttaatttagtaggtggtacggtaccactataactacaacacgaccgtccggaggtaaaccgggtccgaattccaacctactactaccaaagaacgaaacctaaacttaccgaaacggaaaccaactaactttagttaacttacttaaactaaaatacgtaaaacttaaccgtaggaacgtaacgaaccggaggaaccgacggacctaagtagttaacgtacgttaggttgggtacggggtactaacgttttaccggtccggtaaccccgggtcgggggtaaccccgggttaacccgtcgggttaacccctaccccggttcccctaccccccgtacccgtaacccgaaacccccggg

SEQ ID NO: 416525 - DNA, 584 bp, Homo sapiens
  misc_feature: GZ8MTXP02H7RXE.22.85.H08.1.454.CMB.2.raw
  modified_base (350)..(350): a, c, t, g, unknown or other
  modified_base (359)..(359): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtacagtctctgggttcgcagtggcgactacatgagcgtgggtccgccaggcctccgagggaggccgtggagtggatctcactttattatgtggtgtacccanatactacanagactcggagaacgggccgtatcacatctacagaaagacaattccaagaacactattgtaattctacaaaattgaaataaccgtgagacgaccgagacacggacatgtaatacgtgtacggtgggtactagtttacgtcggtaccccggtcgggggtacccgggaacccgtcgggtaccctacccggtcccctacccccgtacccctcccgaaccgtaacccggg

SEQ ID NO: 416526 - DNA, 564 bp, Homo sapiens
  misc_feature: GZ8MTXP02HKJ6F.22.85.H08.1.454.CMB.2.raw
  modified_base (294)..(294): a, c, t, g, unknown or other
  modified_base (396)..(396): a, c, t, g, unknown or other
  modified_base (400)..(400): a, c, t, g, unknown or other
  modified_base (433)..(433): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctcgtgggttctcgagtggcgactacatgagcgtgggtccncgaggctccgaggggaacgggcctggagtggattcgctactttatttatacggtggtcggtaccagtatactacacagctccgtagaagggccatcacatcnaganacattccaagaacacattgatctaacaaagtanaataacctgaagacgaccgaggacacggccaagtgtaatactggtacgtgggactagtttactacgacccgtcggggacccgggaacccgtgggaccctacccgtcctcccccaaccgtacccgaaacccg

SEQ ID NO: 416527 - DNA, 677 bp, Homo sapiens
  misc_feature: GZ8MTXP02JO0Q7.22.85.H08.1.454.CMB.2.raw
  modified_base (254)..(254): a, c, t, g, unknown or other
  modified_base (505)..(505): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcngttctcgtgggttcgtcgaggtcggcgtactacgagtggacgcgtcgggtccccgccgacggtccgtaccggaggggaacgggtcctaggaacggtggtacttaccgtactaactttaagttttacgaggttcggtaccggtacccaatactaacctacaacgaacgtccgtaccggtaggaacgggccctaagttacccaacctattccaacgaaagaacgaactaaattcccgaaaagaccattaagtntactacttaacaaaagttgaaacctaacgtgacggtaagccgaaggaccctagacttagtacgtaatacggtggtaggtacggaccttaaggtttaccgccggaaccccggttgggggacccgaacgtcgtaaccccgtccgtaccctcccccgaacgtaccgaaaccccgg

SEQ ID NO: 416528 - DNA, 728 bp, Homo sapiens
  misc_feature: GZ8MTXP02F5SWQ.22.85.H08.1.454.CMB.2.raw
  modified_base (571)..(571): a, c, t, g, unknown or other
  modified_base (607)..(607): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggttggtggagacgtgggaggaggtcttgatccgacggtccggtggggggtccctggacgacctctcctgtgctagttctcgttcgggttcgtcgaggtcggcgtactacgataggacgtcggtcgggtccccgccgaacggtccgtacggaacggggacgggtacccgtgggtaggtggtacgtccttacgttaactttaagtttactagggttcggtaccggtaaccactaacgttacctaacaaccgaacgtccgtaccggtagggaaaccggtaccgtacttaccaaccgtacttcaaccgaaagaaactaacctaaagtcccgaaaagactaactagttactaactcttaaacgaaattagaaaacgttacnggaaacgacgaaccggaacgtaccgaccggaacttntaacgttacttaggtaggtaggtaggctttaaaacgttcggtacccgacccggggtcggggacccggtaacccgtggtacccctaacccggttcccaaccccctccccgactaaacccggg

SEQ ID NO: 416529 - DNA, 598 bp, Homo sapiens
  misc_feature: GZ8MTXP02GPK41.22.85.H08.1.454.CMB.2.raw
  modified_base (418)..(418): a, c, t, g, unknown or other
  modified_base (422)..(422): a, c, t, g, unknown or other
  modified_base (427)..(427): a, c, t, g, unknown or other
  modified_base (438)..(438): a, c, t, g, unknown or other
  modified_base (442)..(442): a, c, t, g, unknown or other
  modified_base (444)..(444): a, c, t, g, unknown or other
  modified_base (449)..(449): a, c, t, g, unknown or other
  modified_base (453)..(453): a, c, t, g, unknown or other
  modified_base (460)..(460): a, c, t, g, unknown or other
tcagacatacgcgtcacgaccggtgctcgatttagtatcactcagtcggcgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtgggaggaggcttggactccgaggccgtgggggtccctgacgactctcctggtgctagtctcgttgggttctcaggtggcgactacagtgagcgtcggcccgccgaggcgtaccggaggggacggtcctagggagtggtactctcgtaactttattagtaggttggtaccgtaccactatactacacgatccgtcgtagacggtcgatcacntcanaaganacatccagacntatnancttanaatnaactacngagcgacgagcacgtcagtgtatacgtgtaggtggtacttacgttacgttaccggacccggttcgggggaccccggtaaacccgttcggggtaacccctcccggttaccccaccccccgtacgtaccccgaaacccgg

SEQ ID NO: 416530 - DNA, 790 bp, Homo sapiens
  misc_feature: GZ8MTXP02FJQ9B.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtccgccgaggcctccggaaggggaacggggccgtaggggacgtggatcctacttaactttagtttaagtaggttggtaccggtaacccaactaacttaaccttaaccaacgtaacggtacccgttcccgggtaagggaaaccggggtacccgtaactttaccaacctatacctacgaaaggaaacgaaactaaactttaacccgaaaggaaacctaaccgtaatttcggttaaacttaccgtttaaaacctaaaagttaacgtaaaaccgttaaacccgttaggaaacgggaacggaccccgggaaaggaacccgaaccggggtaccctagttaaccggttagtttaaccggtcggttaggggtacgggggtacttaacggttttaaacccgttccggtacccccggggtcgggggtaacccccgggggtaacccgttccgggtacccgtaccccggtacccctaccccccgaccccttaccccgaaaacccccggg

SEQ ID NO: 416531 - DNA, 732 bp, Homo sapiens
  misc_feature: GZ8MTXP02JY4R9.22.85.H08.1.454.CMB.2.raw
  modified_base (311)..(311): a, c, t, g, unknown or other
  modified_base (457)..(457): a, c, t, g, unknown or other
  modified_base (706)..(706): a, c, t, g, unknown or other
tcagacatacgcgtcacgaccggtgctcgatttagtatcactcagtcgcgggggggagaggagcccagcactggggattccgaggtgtttccattcggtgatcagcactgaacacagaggactcaccatggagttttggctgagcttgggttttccttgttgctatttcaaaggtgtccagtgtgaggtgcagttggtggagacgtggaggaggcttgatccgaggccggtgggggtccctggacgtactctcgtgtgctagtctcgtgggttcgtcgaggtcggcgactacagtgacgtcgtcgggtccnccgaggccgtaccggaggggaacgggccgtagggtagtggatcctactaactttatttagagtggtaccgtaccagtactaactacacgacgtaccgtaccggtagggaaccgggtccgtaagttacccaacctactacccgtaanaaaggaaacgtaacctaaccgttaccgaaaacggacctaacgtaagtttacggtaaactttcccttaaaacgaaaagtacggtaaaacctaacccgttggaaacggaccggaccggtaacggaaccgtaccggtacctaagttccgttaaagtccggtggtaggtcgggtacttacggtttaccgtccggaacccccggggtcgggggtaccccggtaaacctcggggtaaccccctccggtacccccncccctaaccccgtcggaaaccccggg

SEQ ID NO: 416532 - DNA, 644 bp, Homo sapiens
  misc_feature: GZ8MTXP02H09M7.22.85.H08.1.454.CMB.2.raw
  modified_base (256)..(256): a, c, t, g, unknown or other
  modified_base (477)..(477): a, c, t, g, unknown or other
  modified_base (485)..(485): a, c, t, g, unknown or other
  modified_base (495)..(495): a, c, t, g, unknown or other
  modified_base (508)..(508): a, c, t, g, unknown or other
  modified_base (533)..(533): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcagttgggtgagagtgggaggagcttgatccgagtccggtgggggtccctgagactctctgtnctagttctcgtgggttcagtgtggctactcagtggcgtcggtcgggcccgaccgacggtcctaccggaaggggaacgtcggtggaagtggacttccgtactatttagttagtaggtggtccgtaaccactagttaacactacgacgtacctcgggtagaacgggcctattaccactacggtcaacaagtaacactacgtacccgaaagtaccattgttaantttaaccnggttaaaaancggaaattaccgngaaacgcgacgggacttacgaccgnttaagtggtacttctggggtacggttggtacttaaccgttcgttacccggacccgggtcggggcccgtaaccgttcgcccttacccgcccctcccccgacacccgaaccgg

SEQ ID NO: 416533 - DNA, 583 bp, Homo sapiens
  misc_feature: GZ8MTXP02JRLVQ.22.85.H08.1.454.CMB.2.raw
  modified_base (433)..(433): a, c, t, g, unknown or other
  modified_base (467)..(467): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctggtttcctgttgctatttcaaaaggtgtccagtgtgaggtgcagttggtggagactggaggaggcttgatccagcctgggggtccctgagactctcctgtgcagtctctgggttctcagtggcgactacatgagctgggtccgccaggctccgagggaacggcctggagtggatctctaactttatttatacggtggtccggttaccatataaccttacacaacggtcctcccggtggaaacggggcccgattcaccctatctcaagaagactaactccaaggaaccanacttgtatcttacaaatgaattaaccagacggancccgaggaccacgggcctaatgtacttatcggtgttggggctagtttaacttcgaccccgttgggggcccgggaacccgtcggtccaccggttccacccctaccctcaaaccccgg

SEQ ID NO: 416534 - DNA, 630 bp, Homo sapiens
  misc_feature: GZ8MTXP02JFBCT.22.85.H08.1.454.CMB.2.raw
  modified_base (252)..(252): a, c, t, g, unknown or other
  modified_base (269)..(269): a, c, t, g, unknown or other
  modified_base (399)..(399): a, c, t, g, unknown or other
  modified_base (429)..(429): a, c, t, g, unknown or other
  modified_base (435)..(435): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagcgtgggtttcctgttgctatttcaaaaggtgtccagtgtgaggtgcagttggtggagactggaggaggcttgatccgagcctggggggtccctgagactctcctgtgacngtctctgggttactcgngtggacgactacgatcggagcgtcgggtcccgaccgaggcctacccggaggggaacgggtccgtggaagtggatccgtcgtacctttatttagtaaggttggtacggttaccacgtatactacacgtacncgttccgagaacgggtcccgattaccactntcctanaagtaagaacctactaccgaagaacctataagttgtacttataaccgtaaatacgaacgtaacctgggaactacgaccgacgacgtaccgcgtagtagttactgtggtcggtaggtactaacgtttcgccggtacccgggtacggggccggtaacgtccggaccctacccgacccacccaaccccgactaaccgg

SEQ ID NO: 416535 - DNA, 684 bp, Homo sapiens
  misc_feature: GZ8MTXP02JCRMG.22.85.H08.1.454.CMB.2.raw
  modified_base (174)..(174): a, c, t, g, unknown or other
  modified_base (477)..(477): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctattcaaaaggtntccagtgtgaggtgcagttggtggagacgtggaggaggcttgactccaggccgtgggggtccctggacgactctcctgtgcagtctcgtgggttcgtcaggtggcgtactacatgacgcgttgggccccgccgaggctccgaggggaacggccgtggagtcggatctctactttatttagtagtggtacgtacccagtatacgtacacagtcctcggtaggaacgggccctagttacaccgtatctacgaagtaaagactaacgttccgaaaggaaccaacgtattacgtactacgtttaaanaaaggttacaaacgttaacctagaagtaaccgaccggaaggaccgacgggtaccaagttagtacgttaagttcgggtcgggttaggggtacctttaggttttaccgtaccggtaccccgggtacgggggtaaccccggggtaacccctcgggggttacccaccccggttacccctacccccaaacccccgttccaaaacccccgggg

SEQ ID NO: 416536 - DNA, 840 bp, Homo sapiens
  misc_feature: GZ8MTXP02FREEN.22.85.H08.1.454.CMB.2.raw
  modified_base (176)..(176): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagcttgggttttccttgttgctatttcaaaaggtntccagtgtgaggtgcaggttggtggagacgtggaggaggcttgatccagccgtgggggtccctgagactctcctgtgctacgtctcgttgggttcgtcgaggtggacgtactacagtgacgtccgtcggggtcccgcgacggcctaccggaaggggaacgggtcccgtaggggacggtgggtaactccttacgttaaacctttaagtttaagtacgggttggtacccggtaaacccaacgtactaaaccgtaacctaacgaacgtacccggtaccggttagggaaaccgggggtaccctatttacccgaaccctaaattcccgtaacgaaaacgaaacgtaaacctaaaacgtttacccgaaaacgggtaaacctaaaccgttaactttagtaaacgtttacctttaaacctaaaaacgtaagtaaaaaccgttaaacccgtagggaaacggtaaccggaacccggaacggggaaacccgtaacccgggtaaccctaaagttaccggtttaaaagttaaccgttcggggttagggtttcgggggaacttttacggtttaccgttccgggtacccccggggtacggggtacccccgggggtaaaccgttccgggtacccgtaccccggtccctacccccgtaccccgtacccgtaaacccccggg

SEQ ID NO: 416537 - DNA, 685 bp, Homo sapiens
  misc_feature: GZ8MTXP02IX6YT.22.85.H08.1.454.CMB.2.raw
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagcgtgggagggaggcttgatccgagtccgtgggggtccctgacgactctcctgtgcagtctcgtgggttctcgagtcggacgactacatgacgcgtcgggtcccgcgacggcctaccggaggggtaacgggccgtagggtacggtggtaactcgtacttactttatttacgtagtggtacgtacctactatactacacagaccgtcgtaggaaacgggcctattccgaaactctactacgaacgaaacgaacgtaaacttaacccgaaaggtaaaccctattaatttacgtaacttcttaaacgaaaatacggtaaactaaccgtagacgaacgacccggagaccgacgtcgattacgtaagtcgttaggtcggtagggtcttaacgtttaccggtccggtaaccccggtggggggtaaccccggtaaccgtttccggacgttacccccggtcccctacccccgtaccccgtacccgaaacccggg

SEQ ID NO: 416538 - DNA, 518 bp, Homo sapiens
  misc_feature: GZ8MTXP02G8TEX.22.85.H08.1.454.CMB.2.raw
  modified_base (384)..(384): a, c, t, g, unknown or other
  modified_base (495)..(518): a, c, t, g, unknown or other
tcagacatacgcgtcacgaccggtgctcgatttagtatcactcagtcgcgggcaggctccagggaagggcctgggagtggatctcacttatttatagtggtggtaccacatactacacagacctccgtgaagggccgattcaccatctcagaagacaattccaggaacacattgtatcttacaaatgaataactgagagccgagacacggccatgtattactgtggtgggctatttacgtcgccccggtggggcccgggtacctggtccacccgtcctccccaccctccaccgacggcccatctcgtcccctcccccgtgcccctaccccgtcctaccgaacgccgcctaccgtcggtcgggggccaccgcggccggtcccggnggctcggccgtcggtaccgaaacggtcccttaccgtacccgaccggtcgttacgttcggtactggggtacgggccggggacgtcgggaacggaaacggcgacctagaggcnnnnnnnnnnnnnnnnnnnnnnnn

SEQ ID NO: 416539 - DNA, 700 bp, Homo sapiens
  misc_feature: GZ8MTXP02JH2IM.22.85.H08.1.454.CMB.2.raw
  modified_base (486)..(486): a, c, t, g, unknown or other
tcagacatacgcgtcacgaccggtgctcgatttagtatcactcagtcgcggggggagaggagcccagcactgggattccgaggtgtttccattcggtgatcagcactgaacacagaggactcaccatggagttttggctgagctgggttttccttgttgctatttcaaaaggtgtccagtgtgaggtgctaggttggtggagactggaggaggcttgatccaggccgtgggggtccctggatactctcctgtgcagtctcgttggggttcgtcgagtcggcgtactacagtggagcgtcgggtcccgccgacggcctacccggaaggggaacgggtcccgtgggtacggtacggacttcctacgtacttttaagtttagtacgggttggtaccccggttaaccaccgtaactaaccgtaacctacgaacggtcctacccgggttaggaaaccggggtccagttaccaccgatcccgtagaacgaanaactaactaccgaagtaccacgtattacgattacttaacaaagtataaacctacgagtacgaacgtccgaagggacctacggccaagttgtaactcgttaggtcggtacgggtctaacttttacggaccgtaccccgggtacgggggtaccccgggtaaccttacggtaccccgtacccggtacccttacccccgacccgttacccgaaacccg

SEQ ID NO: 416540 - DNA, 636 bp, Homo sapiens
  misc_feature: GZ8MTXP02FWE8Z.22.85.H08.1.454.CMB.2.raw
  modified_base (298)..(298): a, c, t, g, unknown or other
  modified_base (398)..(398): a, c, t, g, unknown or other
tcagacatacgcgtcacgaccggtgctcgatttagtatcactcagtcgcgggggggagaggagcccagcactgggattccgaggtgtttccattcggtgatcagcactgaacacagaggactcaccatggagttttggctgagctgggttttccttgtgctatttcaaaggtgtccagtgtgaggtgcagttggtggagactggaggaggcttgatccgagccgtgggggtccctgagactctcctgtgcagtctcgtgggttcgtcaggtggccgtactacatgagcgtcgggtccnccgaggctccgaggggaaggccgtggagtgactctctacttattataggtgtacgtaccacatactacgacacgtctccgtagaaggcccgattacaccnttcatacgaagaactaattacaagaacacgtatttcgaattcttaactaaataggtaaactaaccgtgaaggacgaccgagacccacggtacctagtacgttaattcgtaggtggtaggggtaccttaacgttttacggtcccgaaccccgggtcggggggtaacccccgggtaaccggttacggtacctaacccccggttcccctacccccgtaccccgttacccaaacccccgggg

SEQ ID NO: 416541 - DNA, 578 bp, Homo sapiens
  misc_feature: GZ8MTXP01CCXC1.8.26.C04.1.454.CMB.2.raw
  modified_base (521)..(521): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgcctaggggtcactcaccctgccccgattaacgttggacaggaacccttggcttccggcgagcgggcttttcgacccgctttatcgttacttatcgtcagcatcgcacttctgatacctccagcatcgctcacacgcacacctactacacgactacacaacgactcccctacccaaccaacaccactaacacgtcgctcgccgccacgctcgtcgtcnctgttacgtcccgttccttacttccttccctccctactctcgacgacaacgcgaacg

SEQ ID NO: 416542 - DNA, 597 bp, Homo sapiens
  misc_feature: GZ8MTXP01CBPVL.8.26.C04.1.454.CMB.2.raw
  modified_base (413)..(413): a, c, t, g, unknown or other
  modified_base (513)..(513): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctaccgcttaaaccgggacaaccgtcgcccggccaacatagccttctccgtcccccttcgcagtaacaccaagtacaggaatattaacctgtttcccatcgactacgcctttcggcctcgcctagggtcgactcaccctgccccgattaacgttggacaggaacccttggtcttccggcgagcgggcttttcaccgctttatcgttacttatcgtcagcattcgcacttcngactacctccagcatgcctcacagcacacctttcacaggcttaacagaaccgcctaccccctaacccaaacaaccgcaactaacgccgtcgctgcccgtnacgtcgttcggtctcttagttcggttaccgtccccgtttcaccgttcccttcccgcctactcgtaggacgacctcggcggaacg

SEQ ID NO: 416543 - DNA, 575 bp, Homo sapiens
  misc_feature: GZ8MTXP01CA94D.8.26.C04.1.454.CMB.2.raw
  modified_base (542)..(542): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgcctaggggtcgactcaccctgccccgattaacgtgacaggacccttggtcttccggcgagcgggcttttcgacccgtctttatcgttacttatcgtcagcattcgctacttctgactacctccagcatcgcctcacagcacaccttcacagctacagaacgcctacccctaccaacaacgcaataacgcgtcgctcgcccgcacgcttcggtgcttagttcggtttacgccccgttttnacgttccttcccgcatctgacgacaacgcgaag

SEQ ID NO: 416544 - DNA, 583 bp, Homo sapiens
  misc_feature: GZ8MTXP01DDFIN.8.26.C04.1.454.CMB.2.raw
  modified_base (317)..(317): a, c, t, g, unknown or other
  modified_base (329)..(329): a, c, t, g, unknown or other
  modified_base (346)..(346): a, c, t, g, unknown or other
tcagctcgcgtgtccacgaccggtgctcgatttagtctagcgactttgggtttggggagggttggtacagcctgggggtccctgagactctcctgtgcagcctctggattcacctctggcagctttgtcatgagctgggtccgccaggctccgagggaaggggctgggagtgggtctcatctatgagtggtagtggtggtcacacacactacgcagactccgtgaaggccgttcacatctccagagacaattccaaagaacacggtgtatctgcaaaatgaaacagcctgagagccgagacacggccgtatattacngtgcgaaaagtnttttgttcggagacctntattatatacggtatggaacgtcgtggggccaaaggggacccacggtcaccgtctccctcacgcctccaccaacgggcccatccggtccttccccctcggccacccctcctacccaaggacgaccaccctcgcgggggccacgacgccgggcccgtcggggcctcggccctcgggtcaaacgggaccttacgttccgacaccggccgagcctggaacgcgggcttcgggcaagggcc

SEQ ID NO: 416545 - DNA, 577 bp, Homo sapiens
  misc_feature: GZ8MTXP01AKXCY.8.26.C04.1.454.CMB.2.raw
  modified_base (411)..(411): a, c, t, g, unknown or other
  modified_base (436)..(436): a, c, t, g, unknown or other
  modified_base (460)..(460): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacacaagtacagaatattaacctgttccatcgactacgcctttcggcctcgctagggtcactcaccctgccccgattaacgtggacaggaacccttggcttcggcgagcgggctttcgacccgtagtttacgcgttacttagtcgtcagcattcgctacttcngactacctccagcatcgctcacacncacacctacacacgctacacaacncctacccacccaacaacacactaacgcgcgccgcgcgcgtcgtcgtcggtcgtcgttgttcgttccgttcccgttcttccgttccttcccgtcctctctcgacgaccgtaacgcgcg

SEQ ID NO: 416546 - DNA, 601 bp, Homo sapiens
  misc_feature: GZ8MTXP01CKEBH.8.26.C04.1.454.CMB.2.raw
  modified_base (373)..(373): a, c, t, g, unknown or other
  modified_base (379)..(379): a, c, t, g, unknown or other
  modified_base (482)..(482): a, c, t, g, unknown or other
  modified_base (542)..(542): a, c, t, g, unknown or other
  modified_base (567)..(567): a, c, t, g, unknown or other
  modified_base (589)..(589): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatacgccttctccgtcccccttcgcagtaacaccaagtacaggaatattaacctgttccatcgactacgcctttcgcctcgcctagggtcactcaccctgcccgattaacgtggacacggaccttggtctccggcgagcggcttttcaccgtntttacncgttactatcgtcagctatcgactacttctcgtacttaaccctccagaccatcgacctcaacacgccacctacccttcaaccaggtaccttaacacgaaaccnccctaacccctacccaaacaaccgcaataacgcgtcgctacgccgtcacgtctcgggtcncttagttcgtttacgccccgttttnacttccttcccgcatctggacnccgaacgcgaag

SEQ ID NO: 416547 - DNA, 784 bp, Homo sapiens
  misc_feature: GZ8MTXP01DYSX6.8.26.C04.1.454.CMB.2.raw
tcagctcgcgtgtccacgaccggtgctcgatttagtctagcgactttgggtttggggggaagaggaagactgacggtcccccctgggattttcaggtgctttcatttggtgatcaggactgaacagagagaactcaccatggagtttgggctgagctggcttattttcttgtggcttaattttaaaaggtgtccagtgtgaggtgcagttggttggagtcgtggggggagggttggtacaggccgtggggggtccctgagactctcctgtgcagcctcgtggattcacctcgtggcagtctttgcagtgacgcgtcgggtccgccgagggccgtaccgagggggaacgggggcgttaggggaggttcggggtctcgagttcgttaagtgggaggttagggttaacggtggggtacggtaccaacaaccaaaccgaacctaacgggaccaacggtacccgttaccggtacggggaacggggtccccggtttaccaaccgtacttccacccgaaaggtaacgtaaacctaaacgtttaccgaaaacgtaaacgtacggggttactaagttaccgtaacggtaaaccaaaagttaccggaaacctaacggacccgttagggaacgaccggaaacccggacggggaaaccgtacgggttacccgttaaagttaacgtttcgttagggttaacgttaacggttaaaagttttgtttttacgggttacggacgttaacccttattaaacgttttagtaccgttagggtttcgttaacggggttaacccgg

SEQ ID NO: 416548 - DNA, 646 bp, Homo sapiens
  misc_feature: GZ8MTXP01CM2SG.8.26.C04.1.454.CMB.2.raw
  modified_base (369)..(369): a, c, t, g, unknown or other
  modified_base (389)..(389): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctaggaaaaccagccctacccgcttaaaaccgggacaaccgtcgcccggccaaacatacgccttcctcccgtccccccttcgcagtaacaccaagtacagaatattaacctgttcccatcgactacgcctttcggcctcgccgtaggggcactcaccctgccccgtattaacgttggacacggaacccttggtctccggngacgcggtcttttcaccgtnttatcgttacttatcgtcagctattcgacacttctgtaactcctccagcatcgccctacacacgcaccacttacacgacgcttacacgaaccgcctacccctaaccaacgtaaccgctaacaacgccgtcgcgtacgcccgctacgtccgttcgggtcgtcgttacgtttacggttacccgttcccccgtttcaccgttcccgtttcccccgcctactttaaccgtacgtaacggttaccgaaccggccgtaaccgg

SEQ ID NO: 416549 - DNA, 617 bp, Homo sapiens
  misc_feature: GZ8MTXP01ETU5V.8.26.C04.1.454.CMB.2.raw
  modified_base (370)..(370): a, c, t, g, unknown or other
  modified_base (388)..(388): a, c, t, g, unknown or other
  modified_base (406)..(406): a, c, t, g, unknown or other
  modified_base (420)..(420): a, c, t, g, unknown or other
  modified_base (427)..(427): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgtttcccatcgactacgcctttcggcctcgcctaggggtcgacctcacctcgcccatacgtgacagacctgtctcggcgagcggtctttcgccgtnttactcgttactatcgtnagctatcgactacttctntactaccctcaacnctactcncctacacacgaccacctacctacacgtacgtactaacgacgtaaccacccctaaccccaaaccgaaacgaacgactaacgtaacgccgtccgcgtaccgccgtctacgtcgttcggtcgtcgttacgttcggtttaccgttcccgttccttcgttcccttccctcctactcgtcgacgacgtaacgcgcg

SEQ ID NO: 416550 - DNA, 799 bp, Homo sapiens
  misc_feature: GZ8MTXP01BHHLU.8.26.C04.1.454.CMB.2.raw
  modified_base (282)..(282): a, c, t, g, unknown or other
  modified_base (289)..(289): a, c, t, g, unknown or other
  modified_base (336)..(336): a, c, t, g, unknown or other
tcagctcgcgtgtccacgaccggtgctcgatttagtctagcgactttgggtttggggggaagaggaagactgaccggtcccccctgggattttcaggtgctttcatttggtgatcaggactgaacagagagaactcaccatggagtttgggctgagctggcttattttcttgtggtcttaattttaaaaggtgtccagtgtgaggtgctagttggttggaggtcggtgggggagggttggtacgacggccggtgggggtccctgagtactcctcctgtcgcncgtcctntggtacttccacctcgtggctgtcttgcagtgagtcgtcgggtcccncgaggccgtaccggaggggaacggggtcgtagggtacggtgggtctagtacttgtaagtggtaggttgggtaggttcgggtgtacaaccaaccgaaacctaaccgtccggactaaacggtacccggttacccgggtaaggggtaaacccggggtccgttaacccgaccctacgtcccgtaaccgaaggtaaacgtaacctaaacgttaaacccgaaaggtaaacccgtacggttacgtaacttacgtaacggaaacctaaaaggttccgaaatacccggtccgtaaggacggaaaccgacccgggtaacggtaaccggtaacccggttacttaacgttaaacgttcgttagggttacgaacggtttaaaaggtttcgtttttcgggttaccgggttaacttaacccgttaactttaaggtttttaacctaacggtttacggtaaccggttgggtaaccccggg

SEQ ID NO: 416551 - DNA, 683 bp, Homo sapiens
  misc_feature: GZ8MTXP02G1XDR.8.26.C04.1.454.CMB.2.raw
  modified_base (318)..(318): a, c, t, g, unknown or other
  modified_base (328)..(328): a, c, t, g, unknown or other
  modified_base (346)..(346): a, c, t, g, unknown or other
tcagctcgcgtgtccacgaccggtgctcgatttagtctagcgactttgggtttgggggagggttggtacagcctggggggtccctgagactctcctgtgcagcctctggattcacctctggcagctttgtcatgagctgggtccgccaggctccgagggaaggggctggagtgggtctcatctatgagtggtagtggtggtcacacacactacgcagactccgtgaagggccgttcaccatctccagagacaattccaagaacacggtgtatctgacaaatgaacagcctgagagccgaggacacggctatatactgngacgaaagtnttttggtacgagtacctntattattacgtacggtatggacgtcgtcgggggaccaaagggacccacggtccaccgtctccctcacgccctacccaaccgaacggcccctacgttcccggtacccttcccccgtcgggaccctacccccgtcccgtacccaaacgaccgtacccacccgttccgggtacgggggacccacggaccgggcccgggtccccggttcggggcccgttcgggccccgttacggggtacccgtaaaccggggtacccttaacccggttaccccggaaaccgacccggccggaacggccgtcgggaaccggccgggggcgtacggggaccggaacgggcccg

SEQ ID NO: 416552 - DNA, 568 bp, Homo sapiens
  misc_feature: GZ8MTXP02IJOKW.8.26.C04.1.454.CMB.2.raw
  modified_base (508)..(508): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgccttcggcctcgccttagggtcactcaccctgccccgataacgtggacaggaacccttggtcttccggcgagcggcttttcaccgctttatcgttacttatcgtcagcattcgcacttctgatacctccagcatcgcctcacagcacaccttcacagcttacagacgcctacccctaaccaacaacgcaataagcgtcgactgccgcacgcttcggtnctatcggtttacgccccgttttcacgttccttcccgcctactctcgacgacacgacgacg

SEQ ID NO: 416553 - DNA, 572 bp, Homo sapiens
  misc_feature: GZ8MTXP02FVAA8.8.26.C04.1.454.CMB.2.raw
  modified_base (465)..(465): a, c, t, g, unknown or other
  modified_base (507)..(507): a, c, t, g, unknown or other
  modified_base (533)..(533): a, c, t, g, unknown or other
  modified_base (563)..(563): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttcgcagtaacaccaagtacaggaatattaacctgttcccatcgactacgcctttcggcctcgccttaggggtcactcaccctgccccgattaacgtgacaggaacccttggtcttccggcgagcgggctttcacccgtctttatcgttacttatcgtcagctattcgcacttctgatacctccagcatcgcctcacagcacaccttcacagacttacacgaacncctacccctaccaacaacgcaataacgccgtacgctcgccgnacgcttcggtcgctagttcggttacncccgtttcactccttcccgctatcctgacncacgcgacg

SEQ ID NO: 416554 - DNA, 597 bp, Homo sapiens
  misc_feature: GZ8MTXP02G10QX.8.26.C04.1.454.CMB.2.raw
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctcccgtcccccttcgcagtaacaccaagtacaggaatattaacctgtttcccatcgactacgccttcggcctcgccttaggggtcgactcaccctgccccgataacgttggacaggacccttggtcttccggcgagcgggcttttcacccgtctttatcgttacttatcgtcagctattcgctacttctgatacctcagcatcgcctcacagcacacccttcacagcttaacacgaaccgcctaccccctaacccaaaccaacgcaagtaaacgcgtaccgctcgccgcacgtcgttcggtcgctagttcggtttaccgtccccgtttctactcccttcccgcctactcctacgacgaccacgcgacg

SEQ ID NO: 416555 - DNA, 581 bp, Homo sapiens
  misc_feature: GZ8MTXP02HP1DA.8.26.C04.1.454.CMB.2.raw
  modified_base (180)..(180): a, c, t, g, unknown or other
  modified_base (373)..(373): a, c, t, g, unknown or other
  modified_base (426)..(426): a, c, t, g, unknown or other
  modified_base (429)..(429): a, c, t, g, unknown or other
  modified_base (450)..(450): a, c, t, g, unknown or other
  modified_base (536)..(536): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctaccgcttaaaccgggacaaccgtcgcccggccaacatagccttctccgtccccccttgccagtaacaccaagtacagaatattaacctgtttcccatcgactacgcctttcggcctcgccttaggggtcactcacctgccccgattaacgtgacaggaccctggtctcggcgagcgggctttcgaccgnttatcgttactatcgtcagcattcgctactctgactacctccagcatcgcctnacngcacaccttcacagcttacanaaccgctaccctaaccaacacgcaactaagccgtcgcctgcccgcacgtcttcggtcgctagttcggtttacgtcccccgtttacncttcccttcccaaccgtactccgtcgaacggtaccacgcgaccgg

SEQ ID NO: 416556 - DNA, 588 bp, Homo sapiens
  misc_feature: GZ8MTXP02H35PR.8.26.C04.1.454.CMB.2.raw
  modified_base (437)..(437): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctcccgtccccccttcgcagtaacaccaagtacaggaatattaacctgtttcccatcgactacgcctttcggcctcgccttagggtcgactcaccctgccccattaacgtgacaggacctggtctccggcgagcggtctttcgaccgtctttatcgttacttatcgtcagctattcgctacttctgactacctccagcatcgcctcacngcacaccttcacagtactacagaaccgcctacccctaacccaactaccgacaataacgcgtcgctcgccgtacagtcgttcggtcacgtacgttcggttaccgtccccgtttcactttcctacccgctactactcgacgaccacgacgacg

SEQ ID NO: 416557 - DNA, 642 bp, Homo sapiens
  misc_feature: GZ8MTXP02IL58M.8.26.C04.1.454.CMB.2.raw
  modified_base (349)..(349): a, c, t, g, unknown or other
  modified_base (411)..(411): a, c, t, g, unknown or other
  modified_base (426)..(426): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctaccgcttaaaccgggacaaccgtcgcccgcaacatacgccttctccgtcccccttcgcagtaacaccaagtacaggaatattaacctgttccatcgactacgccttcgctcgccttagggcactcaccctgcccgtataacgtgacacggaccttggcttccggngacgtcgggtcttttcgacccgtctttatcgttacttatcgtcagtcattcgctacttcgtnactcctccagcagtncctcacacgcactacccttcgacgtacgtacttaacgacgaccgtccctaccccctaaccaaacaaccgtcacgttaaacgcccgttacgcctcggcccgcgtacgtccgtttacgggtctacccgtggtttaccgggtttacctccccggttttaaccaccgtttcccttacccgaaccgtacgttcgtaccggacgaccgtaccggtacggacg

SEQ ID NO: 416558 - DNA, 592 bp, Homo sapiens
  misc_feature: GZ8MTXP02I3X2Y.8.26.C04.1.454.CMB.2.raw
  modified_base (179)..(179): a, c, t, g, unknown or other
  modified_base (217)..(217): a, c, t, g, unknown or other
  modified_base (424)..(424): a, c, t, g, unknown or other
  modified_base (444)..(444): a, c, t, g, unknown or other
  modified_base (449)..(449): a, c, t, g, unknown or other
  modified_base (522)..(522): a, c, t, g, unknown or other
  modified_base (559)..(559): a, c, t, g, unknown or other
  modified_base (570)..(570): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaccngcctaccgcttaaaccgggcaaccgtcgcccggcaacntacgccttctcccgtcccccttgcagtaacaccaagtacaggaatattaacctgttcccatcgactacgccttcggcctcgccgttaggggcactcaccctcgccccgtattaacgtggacacggtaacccttggtcttccggcgaggccggtcttttccacccgtctttatccgttacttatcgtcagtctattcgctacttcganactaccctcagcatcgcctnacacncactacctacgacaggacttacagaccacctaccccctaaccaaaccacgaccataaacgctacgctcgcccnagtcgtcgtctctacgttcggttaccttcccgttacnccttcctcccnctctcacgacacacgtacgacg

SEQ ID NO: 416559 - DNA, 608 bp, Homo sapiens
  misc_feature: GZ8MTXP02J2NSO.8.26.C04.1.454.CMB.2.raw
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtccccccttgcagtaacaccaagtacagaatattaacctgtttcccatcgactacgcctttcggcctcgccttaggggtcgactcaccctgccccgattaacgttgacaggaacccttggtctcggcgagcggtctttcaccgctttatcgttacttatcgtcagctattcgctacttctgtactccctcagtcatcgccctcacacgcacctacccttcacaggcttacacgaaccgccctacccctacccaacaccgacaactaacgcgtccgctcgccgacagtcttcggtcgactagttcggtttaccgtccccgtttcaccttcccttaccccgcctaacgttccgtacggaacgaccgacggaccgcgg

SEQ ID NO: 416560 - DNA, 592 bp, Homo sapiens
  misc_feature: GZ8MTXP02IWXLX.8.26.C04.1.454.CMB.2.raw
  modified_base (462)..(462): a, c, t, g, unknown or other
  modified_base (502)..(502): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctaccgcttaaaccgggacaaccgtcgcccggccaacatagccttctccgtcccccttcgcagtaacaccaagtacaggaatattaacctgttcccatcgactacgcctttcggcctcgccttagggtcgactcaccctgccccgataacgtgacaggacctggtcttccggcgagcggtctttcgaccgtctttatcgttattatgtcagcattcgctacttctagactacctccagcatcgcctcacagcacaccttcactacggcttacgagaaccncctaccccctaacccaacaacgcaacgtaacgccgtcgcncgcgcgacgtcgtcggtcgtcgtacgttacgttaccgttcccgtttcctaccttccttcccgtccgtactctacgacgacgacgacgacg

SEQ ID NO: 416561 - DNA, 556 bp, Homo sapiens
  misc_feature: GZ8MTXP02FYBCN.8.26.C04.1.454.CMB.2.raw
  modified_base (342)..(342): a, c, t, g, unknown or other
  modified_base (355)..(355): a, c, t, g, unknown or other
  modified_base (369)..(369): a, c, t, g, unknown or other
  modified_base (374)..(374): a, c, t, g, unknown or other
  modified_base (402)..(402): a, c, t, g, unknown or other
  modified_base (418)..(418): a, c, t, g, unknown or other
  modified_base (420)..(420): a, c, t, g, unknown or other
  modified_base (425)..(425): a, c, t, g, unknown or other
  modified_base (449)..(449): a, c, t, g, unknown or other
  modified_base (472)..(472): a, c, t, g, unknown or other
  modified_base (481)..(481): a, c, t, g, unknown or other
  modified_base (501)..(501): a, c, t, g, unknown or other
  modified_base (534)..(534): a, c, t, g, unknown or other
tcagctcgcgtgtccacgaccggtgctcgatttagtctagcgactttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaaacatagccttctccgtccccccttcgcagtaacaccaaagtacaggaatattaaacctgttcccatcgactacgcctttcggcctcgcctagggtcgactcaccctgccccgataacgtgacngacctgctcgcgngcggctttcaccgntttancgttacttatgtcagcattcgcacttcngatacctccagcatcncncacancacacctcacagactacacgaccncctaccccaacaacaacgacaanagcgtcgcncgccgcacgtcgttcgtacnctagttcgttaccgtcccgttcacttcctcccncactctacgacacgacgcgacg

SEQ ID NO: 416562 - DNA, 708 bp, Homo sapiens
  misc_feature: GZ8MTXP02HYZRZ.8.26.C04.1.454.CMB.2.raw
  modified_base (266)..(266): a, c, t, g, unknown or other
  modified_base (273)..(273): a, c, t, g, unknown or other
  modified_base (284)..(284): a, c, t, g, unknown or other
  modified_base (515)..(515): a, c, t, g, unknown or other
tcagctcgcgtgtccacgaccggtgctcgatttagtctagcgactttgggtttgggggaagaggaagactgacggtcccccctgggattttcaggtgcttttcatttggtgatcaggactgaacagagagaactcaccatggagtttgggctgagctggctattttcttgtggctaattttaaaaggtgtccagtgtgaggtgcagttgttggagtcgtgggggtaggttggtacagccgtggggggtccctgagactctcctgtncagcctngtattcacctnggcagtcttttgctatggagtcgtcggggtcccgccgagggaccgtccggaagggggtaacggggcgttacggggtagggttcgggttctactagttacgttagtagggtaggtttgggtaacggttggggtacgtacaacgacaaccgtacgtaccgtacgacgtaccgtccgtaggaaccgggtccgttaccacctagtcctacgagacgaaactaaacttaccgaaanaaccgtacgttagtaactccgtagaaactaaagacgaactaccgacgtagaacgacggaccgtggaacgtacggacgttaaattacgttacgtgtaacggaaacgttaaagtttacgtttttacgggttacccggacgttaacctttacgttaaagtttttaacttaaccggtaggttacgttacggtaccgg

SEQ ID NO: 416563 - DNA, 509 bp, Homo sapiens
  misc_feature: GZ8MTXP01D2DY7.51.35.D02.1.454.CMB.2.raw
  modified_base (313)..(313): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggcccctnagggatccctgagcgattcctctggctccaggtcagggcaacggtcacattggcatcagtgagtcaggcagaggacgaggctgactattattgtacaatcaaacagacaaccattggtaacttatgtcttcggaatgcgacaaaggttcaccgtcttgggttcagcccaaggcccaacccacttgtccaacttccg

SEQ ID NO: 416564 - DNA, 502 bp, Homo sapiens
  misc_feature: GZ8MTXP01EE7IS.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattcctctggctccaggtcagggcaacggtcacattggcatcagtgagtcaggcagaggacgaggctgactattattgcaatcaacagacaccattggtacttatgtcttggaactgcacaaggttcaccgtccttgggttcacgcccaaggcccaacccattcgtcaacttcc

SEQ ID NO: 416565 - DNA, 523 bp, Homo sapiens
  misc_feature: GZ8MTXP01EU87I.51.35.D02.1.454.CMB.2.raw
  modified_base (451)..(451): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggccaggcccctgtgttggtgatgtaataaagacactgagaggccctcagggatccctgagcgattcctctggctccgaggtacagggaacaaacgggtcacattcgggccatcagtggagtccgaggcaggaggacgaggctagactattattgtacaatcaaacagacaccattggtacttatntcttcggaatgcgacaaggttcaccgtcttgggttcacgcccaaggcccaaccccgacttcgtcaacttccg

SEQ ID NO: 416566 - DNA, 513 bp, Homo sapiens
  misc_feature: GZ8MTXP01EMDBU.51.35.D02.1.454.CMB.2.raw
  modified_base (238)..(238): a, c, t, g, unknown or other
  modified_base (403)..(403): a, c, t, g, unknown or other
  modified_base (477)..(477): a, c, t, g, unknown or other
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaaccgntatgcttattggtacagcagaagccgggccaggcccctgtgtggtgatgtataaagacactgagaggcccctcgaggggactcccctgagcgattcctctggctccgaggtcaggggaacaacggtcacattggccatcagtgagtccaggcagaggacgaggcngactattatgtcaattcaaacagacaccatttggtacttatgtcttcgggaaactgcgaccaagttcgacgtcngggttcagcccaggcccaacccattcgtcaactccg

SEQ ID NO: 416567 - DNA, 510 bp, Homo sapiens
  misc_feature: GZ8MTXP01E5IYG.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggcccctcagggactccctgagcgattcctctggctccaggtcagggaacaacggtcacatggccatcagtgagtccaggcagaggacgaggctgactattatgtcaatcaacagacaccattggtacttatgtcttcggaactgcgacaaggttcaccgtcttgggttcacgcccaggcccaacccacttcgtccaacgttccg

SEQ ID NO: 416568 - DNA, 505 bp, Homo sapiens
  misc_feature: GZ8MTXP01AQUX7.51.35.D02.1.454.CMB.2.raw
  modified_base (420)..(420): a, c, t, g, unknown or other
  modified_base (471)..(471): a, c, t, g, unknown or other
  modified_base (496)..(496): a, c, t, g, unknown or other
  modified_base (498)..(498): a, c, t, g, unknown or other
  modified_base (502)..(502): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctcgagggatccctgagcgtattctctggctccaggtcaggggcaacgggtcacattggccatcagtggagtccagggcagaggacgaggctgactatattgacaatcaanagacaccattggtaacttatgtcttcggaactgcgacaaggttcaccgtcngggttcacgcccaggcccaaccccncnctcnctc

SEQ ID NO: 416569 - DNA, 528 bp, Homo sapiens
  misc_feature: GZ8MTXP01DUELN.51.35.D02.1.454.CMB.2.raw
  modified_base (435)..(435): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtaataaagacactgagaggccctgagggactccctgagcgtattcctctggcctccgaggtcgagggtaacaaacgggtcaacagttgggccaatcaagtgagtccaggcagaggacgaggctagactattatgacaatcaaanagacaccagttgtactatgtcttcgggaatgcgactaaaggttccacggtcttgggttcacggcccaaggcccaaccccagttctcaacttcc

SEQ ID NO: 416570 - DNA, 514 bp, Homo sapiens
  misc_feature: GZ8MTXP01AVS95.51.35.D02.1.454.CMB.2.raw
  modified_base (419)..(419): a, c, t, g, unknown or other
  modified_base (437)..(437): a, c, t, g, unknown or other
  modified_base (499)..(499): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggcccctgtgtggtgatgtataaagacactgagaggcccctgagggactccctgagcgatttcctctggctccgaggtcagggcaacggtcacatggccatcagtggagtccgaggcagaggacgaggctgactatattgacaatcaanagacaccattggtacttntgtcttcggaactgacgacaaggttcaaccgtcttgggttcacgcccaaggcccaaccccgnttcgtccaacgttcc

SEQ ID NO: 416571 - DNA, 511 bp, Homo sapiens
  misc_feature: GZ8MTXP01DMLV1.51.35.D02.1.454.CMB.2.raw
  modified_base (238)..(238): a, c, t, g, unknown or other
  modified_base (498)..(498): a, c, t, g, unknown or other
  modified_base (506)..(506): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagccggccaggcccctgtgttggtgatgtataaagacactgagaggccctcagggatccctgagcgattcctctggctccaggtcagggcaacggtcacattcggcatcagtggagtccaggcagaggacgaggctgactattattgcaatcaacagacaccattggtaacttatgtcttcggaactgcgaccaaagggttcaccgtcttggggttcacgcccaaaggcccaaaccccncttgtccncttcc

SEQ ID NO: 416572 - DNA, 507 bp, Homo sapiens
  misc_feature: GZ8MTXP01CKPI2.51.35.D02.1.454.CMB.2.raw
  modified_base (238)..(238): a, c, t, g, unknown or other
  modified_base (421)..(421): a, c, t, g, unknown or other
  modified_base (469)..(469): a, c, t, g, unknown or other
  modified_base (495)..(495): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattccctctggctccaggtcagggcaaacgggtcacatggccatcagtggagtccaggcaggaggacgaggctgactattattgtacaatcaanagacaccattggtacttatgtcttcggaactgcgacaaggcaccgtcngggttcacgcccaaggtcccaacccnttcgtcaactcc

SEQ ID NO: 416573 - DNA, 500 bp, Homo sapiens
  misc_feature: GZ8MTXP01AHFG7.51.35.D02.1.454.CMB.2.raw
  modified_base (236)..(236): a, c, t, g, unknown or other
  modified_base (432)..(432): a, c, t, g, unknown or other
  modified_base (486)..(486): a, c, t, g, unknown or other
  modified_base (494)..(494): a, c, t, g, unknown or other
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtacagcagagcggcaggccctgtgtggtgatgtataaagacactgagacggccctcagggatccctgagcgattcctctggctccgaggtcaggggaacacggtcacatggccatcagtgagtccaggcaggaggacgaggctgactattattgcaaatcaaacagaacaccgtattggtacttntgtcttcggaactgcgacaaggttcaccgtcttgggttcaggcccaggccaccncttcgtcncgttcc

SEQ ID NO: 416574 - DNA, 557 bp, Homo sapiens
  misc_feature: GZ8MTXP01BO58M.51.35.D02.1.454.CMB.2.raw
  modified_base (432)..(432): a, c, t, g, unknown or other
  modified_base (454)..(454): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgttggtgatgtataaagacactgagaggccctcgagggactcccgtgagcgtattcctcgtggctccgaggtccagggccaacggtcacagttcggccatcagtgagtccaggcagaggacgaggctagactattattgtacaaatcaaanagacacctagttcggtaacttntgttacgttcggaaaccttggaccgaccgtaaaggttccgtaacccgttccgttggggttcaacgcccaacggaacccaacccgcttcgtccttaacgtcccg

SEQ ID NO: 416575 - DNA, 550 bp, Homo sapiens
  misc_feature: GZ8MTXP01A7O53.51.35.D02.1.454.CMB.2.raw
  modified_base (445)..(445): a, c, t, g, unknown or other
  modified_base (532)..(532): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggccctgtgtggtgatgtataaagacactgagacggccctcgaggggactccccgtgacgcgtatttccctcgtgggcctccgaggtaccaaggggaacaacgggtcacgtagttgggccagtcagtggagtccgaggcaggaggacgaggctgactattattgacaatcaanagactaccagttggtacttatgtcttcggaactggacgacgtaaggttccaccgtcttcgggttcacggcccaacgaacccaacccncttcgtcttaaccttccg

SEQ ID NO: 416576 - DNA, 580 bp, Homo sapiens
  misc_feature: GZ8MTXP01BVWHI.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggccaggccctgtgtggtgatgtataaagacactgagaggcccctgaagggactccctgagcgatttcctctggcctccgaggtacgaagggaacaacgggtcaacattgggccatcagtggatccgagcaggaggacgaggctgacttattagttcgtacaaattacaaacagaacctaacctagtttaggtaactttatcgttacgtttacggaacttggaccgaacctaacgggttcctaacccggttccgttacggggttccacggccccaaacgggccccaaaccccgacttcggtccttaacgttcccg

SEQ ID NO: 416577 - DNA, 513 bp, Homo sapiens
  misc_feature: GZ8MTXP01D2AGN.51.35.D02.1.454.CMB.2.raw
  modified_base (432)..(432): a, c, t, g, unknown or other
  modified_base (475)..(475): a, c, t, g, unknown or other
  modified_base (500)..(500): a, c, t, g, unknown or other
  modified_base (507)..(507): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtacagcagaagccggcaggccctgtgtggtgatgtataaagacactgagaggccctgagggactccctgagcgattcctcgtggctcgaggtcagggaacaaggtcacattggaccagtcagtggagtccgaggcagaggacgaggcagacttattattgacaaatcaaacagacacctnttaggtactatgtcttcgaactgcgttacaggttccacgtcgnggttcacgaacccaggcccaacccnttcgtcncttccg

SEQ ID NO: 416578 - DNA, 575 bp, Homo sapiens
  misc_feature: GZ8MTXP01DC3BA.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggccaggcccctgtgttggtgatgtataaagacactgagaggccctgagggatcccgtgagcgattcccgtctggctccgaggtaccgaagggaaccaacgggtcaacgagttcggaccatccagttggagtccgaggcgagagggacgaggtctagacttaattattagtacaattacgaaacagaccaacctagttacggttaactttagtgtacctttacgggaaacttgacgaccgaaaggttccgaaccggttccttggggttcacggcccaacggcccaaccccacttcgtcttaaccttcccg

SEQ ID NO: 416579 - DNA, 671 bp, Homo sapiens
  misc_feature: GZ8MTXP01APD2I.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtacagcagaagccggcacggccctgtgtggtgatgtataaagacactagagacggccctacgagggactccccgtgacgcgtatttccctcgtggtcctacccgaggtaccgaacggggaaccaaacgggtccaacgtacgtttacgggccctaagtccgaaggttcgggacgtaccgagggacgaggaacgggacgaagggtctaggtaacttatttattcgtaactaatacaaacaacgaacctaaccgtatttacgggttaaactttagttcgttaccgttaccggtaagttcgaaccgaccgtaaacggttcccgtaaacccggttcccgttacggggttcccaaccgggtaaccccaaaccgggtaacccccaaaccccctaccgttacggtaaccccgttaaccgtttccccg

SEQ ID NO: 416580 - DNA, 545 bp, Homo sapiens
  misc_feature: GZ8MTXP01A7VAR.51.35.D02.1.454.CMB.2.raw
  modified_base (539)..(539): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgtggtgatgtataaagacactgagaggcccctcgagggactcccgtgagcgattcctctggctccgaggtacaaggggaaccaaacgggtcaactagttcgggaccatcagtgagtccgaggcagaggacgagctagactattaatgtacaatcaaacagaactacctagtttaggtaacttagtgttctacggaacttgacgacaaacgggttccaaccgtcgttgggttccacgcccaaggcccaacccgattcgtcncttccc

SEQ ID NO: 416581 - DNA, 540 bp, Homo sapiens
  misc_feature: GZ8MTXP01EXN5C.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttcttcccctcctcactctctgcacaggctctgaggcctcctatgagctgacacagccaccctcggtgtcagtgtcccccaggacagacggccaggatcacctgctctggagatgcattgccaaaccgatatgcttatggtaccagcagaagccgggccaggcccctgtgttggtgatgtataaagacactgagaggcccctcgagggactccccgtgagcgatttcctcgtggctccgaggtcagggcaacgggtcacattcggccatcaggtggagtccgaggcaggaggacgagggctgactattagttgtacaaatcaaacagaacaccaagtttggtacttagtgttcttcggaactgacgaccaaggttccaccgtcttgggttccacgcccaacggccctaacccacttcgtccaacttccg

SEQ ID NO: 416582 - DNA, 537 bp, Homo sapiens
  misc_feature: GZ8MTXP01E3EY4.51.35.D02.1.454.CMB.2.raw
  modified_base (395)..(395): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcaaaccgatatgcttatggtaccagcagaagccggcaggcccctgtgtggtgatgtataaagacactgagaggccctcagggatccctgagcgattcctctggctccaggtcagggaacaacggtcacattggccatcagtggagtcaggcaggaggacgaggcngactattatgtacaatcaaacagacaccagttggtacttatgtacttacggaactgccgaaccgaaaggttccgaaccggtccgttggggttccacggaaccccaagggaaccccaaacccctcgttcgtccaaccttcccg

SEQ ID NO: 416583 - DNA, 541 bp, Homo sapiens
  misc_feature: GZ8MTXP01EN9G6.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggcaggccctgtgttggtgatgtataaagacactgagaggccctcgagggactcccgtgagcgattcctctggctccgaggtcgagggaacaacggtcacattggccatcagtggagtccgaggcaggaggacgaggctgactattattgtacaatacaaacagacaccattaggttacttatcgttacttcggaacttgccgaacgacgggttcaacccggtccttcgggggttcacgcccgaacggcccaaccccacttacgtccttaacttccg

SEQ ID NO: 416584 - DNA, 685 bp, Homo sapiens
  misc_feature: GZ8MTXP01D8TIM.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaacgccgggccacggcccctgtgttggtgatgtaataaagacacgtgagacggcccctcgaagggactcccgtgacgcgtacttcctcgtggctccgaggtaccgaagggaacaaacgggtcaacgtagttcgggacctagttaccgaggttcgggacgtcccgagggacgaagggaacgggacgaagggcctaggtaacttatttagttcgtacgaaattaccaaaacacgaacctaaccgtagtttacgggttaaacctttagtcgttacgtttaccgggaaaccttggacccgaaacccggtaaacggttcccgtaaaccccggttcccggttcgggggttaccaaccgggtaacccccgaaaacgggtccccccaaaaaccccctcgttacccggtaacccttaacccgttttcccccgg

SEQ ID NO: 416585 - DNA, 702 bp, Homo sapiens
  misc_feature: GZ8MTXP01ED6V4.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgtcttattggtaccagacagaacggccgggccacggcccctgtggtttggtgatagtaaataaagacacgtaggaaggacggccccttacgaaggggtactcccgttggacgcgtactttccctcgtcggccgtccgagggtaccgaaggggaaccgtaacgggtccaacgtagtttcgggacctagtcgaggtggacgtccgaggacgaggacgggacggaggctaggaacttaagttagttcgtacgaaacttacaaacacgtaacctaacctagtttacggttaacttttagtacgtttccgttaacggggtaaccttaacggacccgttaaaccggtaaacgggttacccgtaaacccggtttccggttacgggggttccaacccgggaaccccgaaacgggaacccccctaaaccccggtacttcccggttaacccgttaaccgttttccccgg

SEQ ID NO: 416586 - DNA, 629 bp, Homo sapiens
  misc_feature: GZ8MTXP01EIVQ8.51.35.D02.1.454.CMB.2.raw
  modified_base (295)..(295): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattcgacccaaacgatatgtacttattggtaccagcaagaacggccggccacggccccgtgtgttggntatagtaaataaaagacctacgtaggaaggacggtcccctaggaaggggtaccttcccgtaggacgcgtactttccccgtcgtggccctacccgtagggtaccgaaggggaaccgtaacggtaccaacgtagttcgggacatacgaggttcgacgtccgaggacaggacggacgaggctagaactattattgaactaatacaaacagaccaaccgtagttaggtaaccttagtcgttacttacggaacttggaccaaacgacgttccgaaccgttccgagggttcacccgaacccgaacgaaccccaacccacgttgtaacccttaacttcccg

SEQ ID NO: 416587 - DNA, 577 bp, Homo sapiens
  misc_feature: GZ8MTXP01DBTFS.51.35.D02.1.454.CMB.2.raw
  modified_base (166)..(166): a, c, t, g, unknown or other
  modified_base (440)..(440): a, c, t, g, unknown or other
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacngccaccctcggtgtcagtgtccccaggacagacggccaggatcacctgctctggagatgcattgacccaaaaccgatatgcttattggtaccagcagaagccggccaggccctgtgttggtgatgtaataaagacactgagacggcccctcgagggactcccgtggagcgactttcctcgtggcctccgaggtcgaagggaacaaacgggtcaacatcggccatcagtgagtccgaggcagaggacgaggctgactattattgacaaatcaaanacgaacacctagttggttacttatgtacttcggaactcgcgaaccgtaaaggttcctaacccggttccgaggggttccacggaacccccaaaacgggcccccaaaacccccgacttcggtcccttaaccgtttcccg

SEQ ID NO: 416588 - DNA, 532 bp, Homo sapiens
  misc_feature: GZ8MTXP01DQ7D7.51.35.D02.1.454.CMB.2.raw
  modified_base (426)..(426): a, c, t, g, unknown or other
  modified_base (523)..(523): a, c, t, g, unknown or other
  modified_base (529)..(529): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtacagcagaagcggccaggccctgtgttggtgatgtataaagacactgagacggccctcgagggactcccgtgagcgtattcctctggcctcccgaggtacaagggaacaaacgggtcaacattggccatcagtggagtccaggcaggaggacgaggctgactattattgtanaaatcaaacagacacctattggtaactttatgtcttcggaacttgcgaaccaaggttcaacccgtcttgggttcacggcccaaaggcccaaaccccnttctcnctc

SEQ ID NO: 416589 - DNA, 529 bp, Homo sapiens
  misc_feature: GZ8MTXP01A5TNK.51.35.D02.1.454.CMB.2.raw
  modified_base (307)..(307): a, c, t, g, unknown or other
  modified_base (359)..(359): a, c, t, g, unknown or other
  modified_base (372)..(372): a, c, t, g, unknown or other
  modified_base (469)..(469): a, c, t, g, unknown or other
  modified_base (485)..(485): a, c, t, g, unknown or other
  modified_base (497)..(497): a, c, t, g, unknown or other
  modified_base (521)..(521): a, c, t, g, unknown or other
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagcgtgggttttcctcgttgctcttttaagaggcgtccagtgtcaggtgcagctgggtggagtcgtggggggggctggtccaggctggggaggtccctgagactctcctgtgcagcctctggatcacttcagtacccatgaaatgcactgggtccncaggctcgaggcaaggggctgggagtgggtgcagttatatctatgatggaancaatagcatacgnagagtaccgtgaaggcgagttgaccgtatctaccagacgacaactacgaagaagtacggttcttacaacaaatagaactagcctaggtacgagtcgngaacggtacacgggtnttagttgttacngttgcgaaggagaactcgattacngcgaaccg

SEQ ID NO: 416590 - DNA, 609 bp, Homo sapiens
  misc_feature: GZ8MTXP01C6SA7.51.35.D02.1.454.CMB.2.raw
  modified_base (340)..(340): a, c, t, g, unknown or other
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctctggagatgcattcgaccaaacgatatgtcttatggtaccagcagaacgccggccacggccctgtgtggtgatgtaataaagacactgagacgccctgaggactccctgacgcgtacttccncgtggctccgaggtaacgacgggaacaacgggtcactagttcgggacctatcgagtggactcgaggctaaggaggacggagctagactattagtcgtacaattacaacagactaacctagtttggtaactttgtcgtttcgtacggtaacttcggaccgttaaccgtaaaggttccgtaacccgggttccgttcggggttcccaaaccggccccgaaaacgggccccctaaaaccccggctttaccggtaacccgttccctttccccgg

SEQ ID NO: 416591 - DNA, 626 bp, Homo sapiens
  misc_feature: GZ8MTXP01BGFY6.51.35.D02.1.454.CMB.2.raw
  modified_base (286)..(286): a, c, t, g, unknown or other
  modified_base (595)..(595): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacgccaggatcacctgctctggagatgcattgaccaaacgatatgtcttattggtaccagcagaagccgggccacggcccctgtgttggngatgtataaagacactgagacggccctcgagggactccctgacgcgattcctcgtggcctcgaggtacgagggaacaacggtcactagttcggacagtcgagtggactccgaggcaggaggacgaggcgtagaacttattagtttacgtacgaattaccaaacgacgaaaccaaccgtagtttaggttaacctttaagtcggttaccttcgggtaaactcgggtaccgaaaccgtaacggggttccctaaacccggtccgtttacgggggccaccgggaaccccaaacccgggtccccaaaacccccgngttacccggtaacccgttaacctttccccgg

SEQ ID NO: 416592 - DNA, 555 bp, Homo sapiens
  misc_feature: GZ8MTXP01A4J84.51.35.D02.1.454.CMB.2.raw
  modified_base (239)..(239): a, c, t, g, unknown or other
tcagcgatcgtatacacgaccggtgctcgatttagcacacgatagttgagtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggcaggcccctgtgttggtgatgtaataaagacactgagacggccctcgagggactccctgagcgtacttctcgtggcctccgaagggtccgaaggggacaacgggtcacgattcgggccaatcgagtggaacgtccgaggcaaggaggacgaggctagactattattggtacaaatcaacagaaccaaccgatttacggtacttaagtcgttactcggaaactgacgtaaccaagggtccaccggttcccgttgggttcaacgcccgaaggcccaacccatcgctaacc

SEQ ID NO: 416593 - DNA, 621 bp, Homo sapiens
  misc_feature: GZ8MTXP01ARCNB.51.35.D02.1.454.CMB.2.raw
  modified_base (474)..(474): a, c, t, g, unknown or other
  modified_base (598)..(598): a, c, t, g, unknown or other
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctcgtggagatgcattcgacccaaaaccgatatgtacttagttggtaccagcagaacgccggccacggccctggtgttggtgatgtaataaagacactgagacggccctcgagggtactcccgtagacgcgtatttcccgtcgtgggcctaccgaggtaccgaagggaaccaacgggtcaactagttcgggcctatcgaggtggacgtccgaggacgaggaggacgaggctagaacttattatcgactaaatacaaanacgaacaaccgtagtttacggtaactttagtcgttaccttacgggaacttggaacccgaaccgtaaacggttccgaacccggttcgttcggggccaccggaacccgaacggaaccccaaacccncgttacgtccaacccgtttcccg

SEQ ID NO: 416594 - DNA, 646 bp, Homo sapiens
  misc_feature: GZ8MTXP01DMT41.51.35.D02.1.454.CMB.2.raw
  modified_base (485)..(485): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccggccaggccctgtgttggtgatgtaataaagacactgaagacggccctacgagggactccctgacgcgattcctcgtggcctccgaggtacgaagggaaccgaaacgggttccaactagtttcgggacccaaagttccgaaggttcgggaacgtcccgaagggccgaaggaagggacgaagggtcctagactaatttagttagtaccgtaaattaccaaanacgaaccacctagtttggtaacttagtgttacgttacggaacttcggaccgttaaccgtaagggttcctaaacccggttccgttaggggttccaacggtaacccccgaaagggtaacccccaaaacccccgtacggttacgtcccttaacccgtttccccg

SEQ ID NO: 416595 - DNA, 700 bp, Homo sapiens
  misc_feature: GZ8MTXP01ETNA8.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttagttggtaccagcagacgccgggcacggccctgtgttggtgatgtaataaacgacacgtagaggacggtcccctcgaagggtactcccgtaggacgcgtactttccccgtcgtcggcccttaccggacgggttaacccgaacgggggtaacccgtaaaccgggttccgaaaccgttacgtttacggggacccctaagtcccgtaagggttagggacgtacccggagggccgaaggggaacgggacggagggtcctaggtaacttaagttacgttgtaacgaaattaccaaacgagaacctacctagtttacggtaactttagtcgttaccgttacggaactcggtacgaaccgtaaacggttccgtacccggttaccggttcgggttaccgaccggaacccgaaccgggccccgtaaacccctcgttccgtaacccttaacccgtttccccg

SEQ ID NO: 416596 - DNA, 585 bp, Homo sapiens
  misc_feature: GZ8MTXP01EXH21.51.35.D02.1.454.CMB.2.raw
  modified_base (239)..(239): a, c, t, g, unknown or other
  modified_base (410)..(410): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagcggcagccctgtgtgtgatgtataaagacactgagacggccctacgagggtactccctgagcgtattcctcgtggctccgaggtaccagggaacaaacggtcactattcgggacctatcagtggagtccgaggcaggaggacgagcggtanactattatgtacaattcaaagacactaccagtttacggtactttagtgtacttacggaaacttggaccgttaaaccgaaagggttcccaacccggttccgttaggggttcccacggaacccccgaaacgggaaccccctaaaccccgacttccggttaacccgaaccctttcccg

SEQ ID NO: 416597 - DNA, 677 bp, Homo sapiens
  misc_feature: GZ8MTXP01C34UH.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctggagatgcattgaccaaacgntatgtcttatggtacagcagaagcggcacggccctgtgttggtgatgtaataaagacactagagacggccctcagggactcccgtagagcgattccctcgtggcctaccgaggttaaccgaagggaaccaaacgggttacaacgtagtttcgggacctagtacctaggttcggacgtcccggaagggaccaagggacgggtaaccggagggaccgttaggaactttaagtttaagttacggtaacgtaaagttaaccgaaaactaacggaaaccctaacccgtaaagtttacgggtttaaaccttttagttcggttactttaccgggaaacgttgaacccgaacgtaaacggttaccgtaacccgttcgttaccgggcaacccggaacccgaaaccgggaaccccaaaccccggtattaccggttccaacgtttccccg

SEQ ID NO: 416598 - DNA, 504 bp, Homo sapiens
  misc_feature: GZ8MTXP01EIR4L.51.35.D02.1.454.CMB.2.raw
  modified_base (260)..(260): a, c, t, g, unknown or other
  modified_base (264)..(264): a, c, t, g, unknown or other
  modified_base (469)..(469): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgatatgcttatggtaccagcngaancggccaggcccctgtgttggtgatgtataaagacactgagaggccctcagggatccctgagcgattcctctggctccaggtcagggcaacggtcacattggccatcagtggagtccaggcagaggacgaggctgactattatgtcaatcaaacagacaccattggtacttatgtcttcggaactgcgaccaaggttcaccgtccngggttcagcccaagccaaccccacttgtccaactc

SEQ ID NO: 416599 - DNA, 664 bp, Homo sapiens
  misc_feature: GZ8MTXP01DWMKA.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgcattcgacccaaaaccgatatgtcttattgtaccagcagaacgccggccacggccctgtgttggtgatgtataaagacactgagacggccctacgagggactcccgtgacgcgtactttccgtctggcctccgaggtaccgaacggggaaccaacgggtcaaactagtttcgggacctagtcgaggttggacgtacccgagggccgaaggacgggacgagggctagaacgttatttagttacgtaacgtaaattaccgaaacacgaacctacccgttaagtttacgggttaactttagttcggttaccgtttacgggaaaccttggacccgttaaaccgtaaacgggttacccgaacccggttccgttcggggttaccaccggaaccccgaaacgggcccccaaaccccgtcgttacgtccttaaccgtttccccg

SEQ ID NO: 416600 - DNA, 724 bp, Homo sapiens
  misc_feature: GZ8MTXP01BR2E9.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgacccaaacgatatgcttattggtaccagcagaagccggccaggccctgtgtggtgatgtataaagacactgagacggccctacgagggactcccgtgagcgtattccctcgtggcctccgaggtccgaaggggtaaccaaacgggttccaaacgtacgtttcggggaccctaagtccgtaaggttcgggaacggtcccgaaggggccgaagggaacggggtaaccggagggtaccgtaggtaaacccttaagtttagtttacggtaccgtaaaacttaccgaaaaccaacgggtaacccaacccgttaaagttttacgggttaaccttttaagttcgttaccgtttaaccggggtaaacttcgggaaccgttaaacccggtaacggggttacctaaccccgggttccgttacgggggttcccaacgggtaacccccgaaacgggtccccgaaaaccccccgtacttccgggtaacccgttaacccgtttccccgg

SEQ ID NO: 416601 - DNA, 537 bp, Homo sapiens
  misc_feature: GZ8MTXP01D40DA.51.35.D02.1.454.CMB.2.raw
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggcgtgggtccaggctgggaggtccctgagactctcctgtgcagcctctggatcacctcagtacccatgaaatgcactgggtccgccaggctccgaggcgaagggggctgggagtggggtgcgagttatatctatgataggaagcaaataagcactacgcagagccgtagaggcgatgaccatctccagagacaactacgaagaacgtacggttacttactaactaaatagaacagacctgagagctgaaggacacggtcttagttgtttacgttgttgacggtaagagggtaactggattacaacggttcaaccg

SEQ ID NO: 416602 - DNA, 513 bp, Homo sapiens
  misc_feature: GZ8MTXP01B1DI8.51.35.D02.1.454.CMB.2.raw
  modified_base (401)..(401): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgtggtgatgtataaagacactgagaggccctcagggactccctgagcgattcctctggctccaggtcagggcaacgggtcacattggccatcagtggagtccaggcaggaggacgaggcngactattattgtcaatcaaacagacaccagttggtacttatgtcttcggaatgcgacaaggttcgaccgtcttgggttcacgcccaggcccaacccattcgtccaacgttcc

SEQ ID NO: 416603 - DNA, 766 bp, Homo sapiens
  misc_feature: GZ8MTXP01DVHTM.51.35.D02.1.454.CMB.2.raw
  modified_base (583)..(583): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgacccaaacgtatatgtacttagttcggtaccagacaaggaacggcccgggaccgaccggtcccgttggtggttggtgagttagtaaacgtaaacggactaccgtaggaaacggccggtacccctaccggaagggtaccttaccccgttaggaacgtccggtaactttccccgtcgtacggtccctacccggtagggtaacccggaacggggaacccgtaaaccgggtaccaaaccgttaacgttccgggacctaagtaccgaagggttacgggacgtacccgaagggacgtaaggggaacggaaccggaggtccgtagttaacttatttagtacttaacgaaatacaaanacgaacctaccgttagtttaggttaaactttgtcgttacgttaacgggactaacggaccgttaaacgaacggttacccgtacccggttccggttacgggttcccgaaaccggtaaccccggtaaaaccggaacccccgtaaaaccccgcctttccggtaaccccttaaccgggttttcccccg

SEQ ID NO: 416604 - DNA, 533 bp, Homo sapiens
  misc_feature: GZ8MTXP01B42EO.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaagccggccaggcccctggtgttggtgatgtaataaagacactgagacggccctcgagggactccctgagcgtattcctcgtggctccgaggtacagggaacaacggtcactagttcggccagtcagtggacgtccgaggcaggacggacgaggctagactagttatgtacaatcaaacagaccacattggtacttatgtctcgaactgcgacgacgttctaccgtcttgggccacgcccaacggcccaaccccattcgtccaacttcccg

SEQ ID NO: 416605 - DNA, 703 bp, Homo sapiens
  misc_feature: GZ8MTXP01AUBTY.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatgtacagcagagccggcaggccctgtgtggtgatgtataaagacacgtgagacggccctgagggactcccgtagagcgtattccctcgtggctccgaggtacgaacgggaaccaacgggtcaacgtagttcgggacctagtaccgaggttacgggaacgtccggaagggaccgaagggtaacggggacggagggtaccgttaggtaaacctttaagttttagtttacggtaacgtaaacgttaaccaaaaccgaacgtaacctaacccgttaagtttacgggtttaacctttagtttacggttaccgtttaccgggtaaccgttaacggacccggttaaaccggtaaacgggttcccgtaacccggttcccggttacggggttaccaccggtaacccccgaaccgggtaacccccaaaccccgtacttaccggtaacccgttaacccgtttccccg

SEQ ID NO: 416606 - DNA, 592 bp, Homo sapiens
  misc_feature: GZ8MTXP01BTK0S.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgatatgcttattggtaccagcagaagccgggccaggcccctgtgttggtgatgtataaagacactgagacggccctcgagggactcccgtgagcgtatttcctcgtggctccgaggtaccgaaggggcaaacgggtcaacgatttcgggccatcaggtggagtccgaggcaggacgggacgaggtctgacttattagttgtctaaatcaacagacacctagttcggttactagttgtctttacggaactcggtcgacccaaaggttccgaacccggttccgttcggggttccaccggaaccccgaaacgggccccaaaaccccccgagttccgtaacccttaaccgtttccccg

SEQ ID NO: 416607 - DNA, 780 bp, Homo sapiens
  misc_feature: GZ8MTXP01BI9I4.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgtcttattggtaccagcagaacgccgggccacggccctgtgttggtgatgtaataaagacactgaagacggccctcgagggactcccgtgacgcgtattcccgtcgtagggcctaccgaggtacgaacggggaaccaaacgacggttcaacgtagtttacggggaccctaagtaccgtaaggtaggggtaacgttacccggaacggggacgaaacgggggaacggggaaccggaacggggtaccgttaacgggtaaacctttaaacgtttttaagtttacgggggttaaccgtaaaacgtttaacccaaaaccgttaaacggaacccttaaacccgttaaaggtttttaccggggttaaaccttttaaggttaccggtttaccgtttaaccggggtaaaccttacggttaacccgggtaaacccgttaaacggggtaccccgtaaacccgggtttcccggttacggggttacccgaaccggaccccgaaaccgggtacccccaaaccccgttaccgttaaccggttcccgttaaccccg

SEQ ID NO: 416608 - DNA, 550 bp, Homo sapiens
  misc_feature: GZ8MTXP01B4SBG.51.35.D02.1.454.CMB.2.raw
  modified_base (534)..(534): a, c, t, g, unknown or other
  modified_base (542)..(542): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccaggccctgtgttggtgatgtataaagacactgagacggccctcgagggactccctgacgcgattcccgtcgtggcctcccgaggtaccgaaggggaacaaaccgggtcacgattcgggccatcagtggacgtccgaggcagaggacgaggctgactattagttgtacaatcgaaactagacacctattggttaacttatgtcttacggaacttgcgaccaaggttcaccgtcgttgggttcacgcccaacggcccaaccccnttcgtccncgttcccg

SEQ ID NO: 416609 - DNA, 687 bp, Homo sapiens
  misc_feature: GZ8MTXP01A05TP.51.35.D02.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgtcttagttgtaccagcagaagccggcacggccctgtgtggtgatgtaataaagacacgtggagacggccctcgagggtactcccgtgacgcgtattccctcgtggcctaccgagggtaccgaaggggaacctaaaccgggtcaacgtaacgttcggggacctaagttccgaaggttcgggaacgtacccgagggaccaagggaacgggaacgagggccgttaggaacttaagttagttcgtactaaaacgttaccaaacgaacggtaacctaaccgtaagtttacgggtttaacctttaagtcggtttaccttaccgggtaaacttaacggaccgttaaccgtaaacgggttcccgtaaacccgggttccgttacggggttccaacccggtaaccccgaaacgggaacccctaaacccctcggttacgtcccaacgtttccccg

SEQ ID NO: 416610 - DNA, 639 bp, Homo sapiens
  misc_feature: GZ8MTXP01D0IGC.51.35.D02.1.454.CMB.2.raw
  modified_base (243)..(243): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccccaggacagacggccaggatcacctgctctggagatgcattcgaccaaaccgntatgtcttattggtaccagcagaagccggcacggccctgtgtggtgatgtataagacactgagacggccctcgagggtactcccgtgagcgtattcctcgtggcctccgaggtcgagggaacctaacgggtccaaacgtgttacggacctagtccgtagtcggacgtccgagggacagggaacggacggaggcgtaggtaacttaatttattacgttacaaagttacaaacgtacggaacctaaccctagttttacggttaacttttagtacgttaccgttacggaacttcggaccgttaaccgtaaacggttccgaccccggttccgttacggggttccaccggaaccccaaacgggccccaacccccgtgttaccgtcccttaacgtttccccg

SEQ ID NO: 416611 - DNA, 704 bp, Homo sapiens
  misc_feature: GZ8MTXP01BG3LF.51.35.D02.1.454.CMB.2.raw
  modified_base (222)..(222): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgctattcgacccaaacgatatgtcttattggtaccagcagaagccggccaggccctgtgttgtgatgtataaagacactgagcggtccctacgagggtactcccgtagacgtcgtactttcccgtcgtggcctaccgagggttaccgaaggggaaccaaccgggtcaacgtcgtttacgggccctagtccaggttacggacgtaccgagggccaagggaacgggacggagggtcctaggtaacttagtttaacgttcggtaactaaacgttaccgaaactaacggaacctaacccgttagtttacgggtttaaactttacgttacggttaccgttaccggtaaacgttcggaacccgttaaaccggtaaacgggtttccgaaccccggttccgttcggggttaccacccggtaacccccgaacgggtaaccccctaaacccccgtagttacccggtaacccttaacccggtttaaccccg

SEQ ID NO: 416612 - DNA, 589 bp, Homo sapiens
  misc_feature: GZ8MTXP01CJJAD.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggccctgtgttggtgatgtaataaagacactagagacggccctcgagggactcccgtgacgcgtattcctcgtggctccgaggtacacggggaacaaacgggtcaacgtagttcggacctaatcgaagtggacgtcccgagggaccaagggaacgggacgaaggccgtaggaacttaagttattacgtacaaattacaaacaagtaccaacctagttaggtaacctttagtgtacgtttacggaactgaccgacgaacggttcgaacccgtcgttgggttcacggccaacggcccaaccccgattcgtccaacgttccc

SEQ ID NO: 416613 - DNA, 749 bp, Homo sapiens
  misc_feature: GZ8MTXP01DK13F.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaacgntatgcttattggtaccagcagaagccggccaggcccctgtgttggtgatagtaataaagacactaggagacggccctcgagggtactcccgtgaacgcgtactttccctcgttcggcctcccgaggtaccgaacgggggtaaccaaacgggttccgaaaccgtacgtttacgggaccctaagttaccgtaagggtgggtacggttacccgaagggccggaaagggaacggggaaccgggaagggtcgtacgggtaaacttaagtttagtttacggttacgtaaacttacgaaaacacggtaacaacccgttaagtttaggttaaacctttaagttcggtttaccgttacgggtaaacgttaacggaccgttaacccgtaaaacgggttccgtaaacccggttcccgttacgggggttacccaaaccgggtaacccccgtaaaaaccggggtaacccccaaaacccccgtaccgtttaccgggttaaccccgttaaccgttttcccccggg

SEQ ID NO: 416614 - DNA, 632 bp, Homo sapiens
  misc_feature: GZ8MTXP01D9C7M.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccgggccacggccctggtgttggtgatgtaataaagacactgagacggccctcgagggactcccgtagacgcgtatttccctcgtggcctccgaggtaccgaagggaaccgtaacgggtcacgtagttcgggcctagtcaggtggaacgtccgaggcgagaagggacgaggctgacttattagttgtacgtaatcaaacagaacacctagtttaggtaactttagtcgttacgttacggaacttcggaccgaaccgtaaacggttcccgaaacccggttccgttacgggggttaccaaccgggaacccccgaaacgggcccctaaaacccccgtcgttccggttaacccgttaacccgtttccccgg

SEQ ID NO: 416615 - DNA, 603 bp, Homo sapiens
  misc_feature: GZ8MTXP01EULHS.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgccaaaccgntatgcttattggtaccagcagaagccgggcaggcccctgtgtggtgatgtataaagacactgagacggccctcgagggactccctgagcgatttcctctggcctccgaggtacagggaacaacgggtcacattggccatcagtggagtccaggcaggaggacgaggctgactattattgtcaaattcaaacagaccacctagtttcggtaactttaagtcgttacgtttacggaacttcggccgaaccgtaaacggggttccaaacccgggtttcccgttacgggggttccaaacccggcccccgaaaacgggccccccttaaaaaccccgccgttaccggtaacccgttaacccttttccccg

SEQ ID NO: 416616 - DNA, 567 bp, Homo sapiens
  misc_feature: GZ8MTXP01CZ1UG.51.35.D02.1.454.CMB.2.raw
  modified_base (239)..(239): a, c, t, g, unknown or other
  modified_base (550)..(550): a, c, t, g, unknown or other
  modified_base (559)..(559): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaacgntatgcttatgtacagcagacgccggcacggccctgtgtggtgatagtataaagacactagagacggccctcgagggactcccgtagacgcgtactttccctcgtggcctccgaggtacgaagggaacgtaacgggtcaactagtcggaccatcgagtggacgtccgaggcgaggaggacgagctagactattatgtacaaatacaaacacgaacacgtagttagttaacttgtcgttcttacggaactggaccgacgtaacggttccgtaccggtcgttacgggttcacggaacccaacggccctaacccncttcgtccncgttcccg

SEQ ID NO: 416617 - DNA, 612 bp, Homo sapiens
  misc_feature: GZ8MTXP01B6R7C.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaacgatatgcttattgtacagcagaagccggcacggcccctgtgtggtgatgtaataaagacacgtgagacggccctagaggactcccgtgagcgtattcctcgtggctccgaggtcagggaactaacggtcactagttcggaccatcgagttggacgtacccgaggccaggacggacggaggctaggacttaattattgtacaagtacaaacgaacgaccacctagttaggttaacctttagtcgttaccttacgggaacttaacggaccttaaccggtaacgttacccgtaaccggttcccgttacggggttccaaccggccccgaaaccgggcccccaaaccccacgttcgtaacccttaaccgtttccccgg

SEQ ID NO: 416618 - DNA, 581 bp, Homo sapiens
  misc_feature: GZ8MTXP01BXIM7.51.35.D02.1.454.CMB.2.raw
  modified_base (434)..(434): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgtcttattggtaccagcagaagccgggccaggcccctgtgttggtgatgtataaagacactgagacggccctcgagggactccctgagcgtattcctctggctccgaggtcaaggggcaacgggtcacagttggccatcagtggagtcaggcagaggacgaggctagacttattagttgtacaatcaaanacgacaacctagttcggttaactttagtcgttacttacgggaacttcggccgttaaaccgtaacgggttccaaccccggttcgttacggggttccaccggaaccccgaaacgggccccaaaaccccgcttacgtccaacctttcccg

SEQ ID NO: 416619 - DNA, 518 bp, Homo sapiens
  misc_feature: GZ8MTXP01ER5DP.51.35.D02.1.454.CMB.2.raw
  modified_base (238)..(238): a, c, t, g, unknown or other
  modified_base (392)..(392): a, c, t, g, unknown or other
  modified_base (402)..(403): a, c, t, g, unknown or other
  modified_base (487)..(487): a, c, t, g, unknown or other
  modified_base (507)..(507): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgatgcctcctatgagctgacacagccaccctcggtgtcagtgtccccaggacagacggccaggatcacctgctctggagatgcattgccaaacgntatgcttattggtaccagcagaacgccgggccaggcccctgtgtggtgatgtataaagacactgagaggccctgagggactccctgagcgacttctcgtggctccgaagggtcgaagggacaacgggtcactattggccatcagtgagtcaggnagaggcgagnngactattatggtacaatcaacagaccactattcggtacttatgtcttcggaactgacgacaaggtcaccgttcgttgggttacncgacccaacggcccaacccntcgttcctaac

SEQ ID NO: 416620 - DNA, 517 bp, Homo sapiens
  misc_feature: GZ8MTXP01C6D5T.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctcgagggactccctgagcgattcctctggctccgaggtcagggcaacggtcacatggccatcagtggagtcaggcagaggacgaggctgactattatgtacaatcaaacagacaccattggtacttgtgtcttcggactgcgacgaaggttcaccgtcttacgggttcacgccccaaaggcccaacccgacttcgtccaacttcccg

SEQ ID NO: 416621 - DNA, 657 bp, Homo sapiens
  misc_feature: GZ8MTXP01B77ZW.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaagccggcacggccctgtgttggtgatgtaataaagacacgtgagacggcccctacgaagggctcccgtgagcgtacttccctcgtggcctcccgaggtccgaagggaacaacgggtcaactagttcgggccctaagtcgaggtgggacgtaccgagggccaagggaacgggacggaggtaccgtaggtaacttaatttagttacgtaacgtaaattaccaaaacacggtaaaccctaacccgttaagtttacggtaaacttttagtacgttaccgttacggaacttcggaaccgaaccgtaaacggttccgaaccgttccgttacggggttccaccggaaccccgaaacggccccaaaccccgtgttaccgtaacccttaaccgtttccccg

SEQ ID NO: 416622 - DNA, 583 bp, Homo sapiens
  misc_feature: GZ8MTXP01EJJ1N.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaaccgatatgtcttattggtaccagcagaagccggccacggccctgtgttggtgatgtaataaagacactggagacggcccctcgagggactcccgtgacgcgactttcctcgtggcctccgaggtcgagggaacaacgggtcactagttcgggaccatcgaggttggacgtccgaggcaggagggacgaggctgactattatgtacaatcaaacagacactagtttacggtaacttatgttctacggaactcgaccgaacgaaacggttccaaccggttccgttaggggttcaccggaaccccgaaacggccccaaaccctcgttacgtaaccttaaccgtttcccg

SEQ ID NO: 416623 - DNA, 591 bp, Homo sapiens
  misc_feature: GZ8MTXP01ANLYS.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagagcggcagccctgtgtggtgatgtataagacactgagaggccctcgagggactccctgagcgtattcctcgtggctccgaggtacagggtaacaacggtcacattggccatcagtgagtcaggcaggaggacgtggctgactattatgtacaatcaacagaacaccgtaattggtaactttagtcgttacgttacggaaacttcggaccgttaaacccgtaaacggggttccaaaccccggttcccgttacgggggttcccaacggtaaccccccgaaaaggggtcccccaaaaacccccggtacttccgggttaacccgaacctttccccggg

SEQ ID NO: 416624 - DNA, 704 bp, Homo sapiens
  misc_feature: GZ8MTXP01BILSY.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaacgatatgcttattggtaccagcagaagccgggccaggcccctgtgttggtgatgtataaagacactgaagacggccctcgagggactccccgtgacgcgtatttccctcgtggctcccgaggtaccgaaggggaaccaaacgggtccaacgtagttcgggaccctaagttccgaaggtgggtaacggtcccgaaggggaccaagggaaggggaaccgagggcctacggtaaccttagtttaagttggtacgaaacttaccaaaccgaacggaaccaaccctagtttacgggtaactttacgtagtttaccgttaccgggaaacttcggaccgttaacccgtaaagggttccccgtaaacccgggttcccgttacgggggttccgaacccggaacccccgtaaaccggggtaaccccccgaaaacccccgtaccttaccgggttaaccccgttaacccgttttcccccgg

SEQ ID NO: 416625 - DNA, 588 bp, Homo sapiens
  misc_feature: GZ8MTXP01AZVTT.51.35.D02.1.454.CMB.2.raw
  modified_base (282)..(282): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttatggtacagcagagccggcacggccctgtgtggngatgtataaagcactgagacggccctgagggactcccgtgacgcgtattccctcgtggcctccgaggtacgaagggaacaacgggtcactagttcggaccatcgaggtggacgtccgagggcaaggagggacgaggctagacttattattagtacaatacaaacagaaccacctaattggttaacttatcgttacttacgggaaactcggacgttaaccgtaaacgggttccgtaaccggttcgttacgggttcaccgaacccgaacggccccaaccccgtacttcgtaaccttaaccgtttcccg

SEQ ID NO: 416626 - DNA, 577 bp, Homo sapiens
  misc_feature: GZ8MTXP01AFIAT.51.35.D02.1.454.CMB.2.raw
  modified_base (283)..(283): a, c, t, g, unknown or other
  modified_base (333)..(333): a, c, t, g, unknown or other
  modified_base (519)..(519): a, c, t, g, unknown or other
  modified_base (553)..(553): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctggtgtcagtgtccccaggacagacggccaggatcacctgctctggagatgcattgaccaaaccgatatgtcttattggtacagcagagccggcacgccctgtgtggtnatgtaataagcactgacgaggccctgagggactccctgagcgtattcccncgtggcctccgaggtaaccgagggaacaacggtcactagtcgaccatcagtggatccgagcaggaggtacgaggctagtactattattgtacaactacaacagacctacgatttaggtactttatcgtcgttacggaatcggacgaaccctaagggttccaacccggttccgttgggggttaaccnccggtaaccccgaaacgggcccccaaacccccgngttaccgtccgttaaccgttcccg

SEQ ID NO: 416627 - DNA, 772 bp, Homo sapiens
  misc_feature: GZ8MTXP01CQZKW.51.35.D02.1.454.CMB.2.raw
  modified_base (222)..(222): a, c, t, g, unknown or other
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacagacggccaggatcactgctctgganatgcattcgaccaaacgatatgtcttattggtaccagcagaagccggcaggccctgtgttggtgatgtaataaagacactgaagacggccctagagggactcccgtgagcgtattccctcgtaggctaccgaggtaccgaaggggaacctaaacgggtctaacgtagttcgggaccctaagtaccgaggttaggaacggttaccccggaagggacccgaaaggggaacgggtaacgggaacgggtacccgttaagggtaaacctttaaagtttaagtttacggtaaaccgtaaaacgtttaaccaaaaaccgaacggtaaaccctaaacccgttaagtttaacggggtttaaaacccttttagttacggtttacccgttttaaccgggaaaaccgttcgggtaaacccgttaaacccgggttaaacggttccccgtaaaccccgggttcccggttacgggggttccaaacccgggtaacccccggaaaaccgggttaacccccaaaacccccgtacgttaccggtaaccccgttaaccttttcccccggg

SEQ ID NO: 416628 - DNA, 730 bp, Homo sapiens
  misc_feature: GZ8MTXP01BANMH.51.35.D02.1.454.CMB.2.raw
  modified_base (223)..(223): a, c, t, g, unknown or other
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgtcttagttggtaccagcagacgcccggcacggccctgtgttggtgatagtaataaagacaacgtggaagacggcccctacgagggactccccgtagacgtcgtattccctcgtcggcctccgaggtaccgaacggggaaccgtaaacggtcctaacgtacgtttcgggacctaaagtccgtagggttacggacggtacccgaggggaccaaggggaacggggacgtacgggtaccgtagggtaaacctttaagtttaagtttaggttaaaccgtaaattaaccaaaacgaacggtaaaccctaacccgtaagttttacgggtaaaccttttagtcgtttaccgtttaacgggaaccgtggtacccgaaaccgtaacgggttacccgtaacccggttcccggttacggggttacaaacccgggaacccccgaaaccgggaaccccaacccccgtacgttaccggtaacccgttaaccctttcccccg

SEQ ID NO: 416629 - DNA, 636 bp, Homo sapiens
  misc_feature: GZ8MTXP01B0IVB.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgtcttattggtaccagcagagccggcaggccctgtgtggtgatgtataagacactgagacggccctcgagggactcccgtgacgcgtatttccctcgtggcctcccgagggtaccaggggaacctaacgggtcactagttcgggccaagtcgaggttggacgtccgagggcaaggagggaacgagggctagacttattattgtacaaatcaaacacgaacctaacctagtttaggtaactttagtcgttcgtttaccgggaaacttcggtaccgaaacccgtaaacgggttcccgtaaacccggtttcccggttaggggttacccacggtaacccccgaacgggaaccccctaaacccctaccgttccggtaacccttaacccgtttccccg

SEQ ID NO: 416630 - DNA, 601 bp, Homo sapiens
  misc_feature: GZ8MTXP01D8633.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgaccaaacgatatgtcttatggtaccagcagagccggcaggccctgtgtggtgatgtataaagcactgaagacggccctcgagggactcccgtagacgcgtatttcctcgtggcctaccgagggtaccgaaggggaacctaaacgggtcaacgtagttcgggacctattcgagtggtactccgaggcgaaggaggacgaaggctagacttagttattgtacgaaatcaaacagaaccactagtttggtaactttgtgttacttacgggaacttcggacgaaccgtaaacggttccaaccggttccgttaggggttccaacggaaccccgaaacggccccaaaccccgtcgttcgtaacccaacgtttccccg

SEQ ID NO: 416631 - DNA, 597 bp, Homo sapiens
  misc_feature: GZ8MTXP01BO7JT.51.35.D02.1.454.CMB.2.raw
  modified_base (353)..(353): a, c, t, g, unknown or other
  modified_base (518)..(518): a, c, t, g, unknown or other
  modified_base (549)..(549): a, c, t, g, unknown or other
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagcgtgggtggaggtcggtggggggggcgtggtccgagggcgtggggacggtccctgagactctcctgtgcagcctctggactcaccttcagtacccatgaaatgcacgtgggtccgccgaggcctccgaggcgaaggggctgggagtggggngcagttactatctagtgataggaagcaaataagacacgtacgcgagacgtccgtgaacgggccgagttacgacctataccgtccaagaacgaactaacgacgaaagtaacgttaacggttcttaactaaactaaatacggaaacacgtaccagtacgagtaccgnggaacggacgacggtacttagttcgtttagnggttggaccggtaagacgggtaacttcggaattacgcgttcgaaccgg

SEQ ID NO: 416632 - DNA, 636 bp, Homo sapiens
  misc_feature: GZ8MTXP01C1NT1.51.35.D02.1.454.CMB.2.raw
  modified_base (603)..(603): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgacccaaaccgatatgcttattggtaccagcagaagccgggccaggcccctgtgttggtgatgtaataaagacactgagacggccctcgagggactcccgtgacgcgtattcctcgtggctccgaggtacgagggaacaacgggtcactagttcgggccatcgagtggacgtccgagggcaggaggacgaggctaggacttaattagttgtacgaattcaaacacgaactaacctagtttacggttaacctttaagtcgttacgttaccgggaaacttcggaccgttaaaccgtaacgggttccgaaacccggttccggttacggggttccaacggtaaccccccgaaaacgggaaccccccgtaaaacccccnccgttaccggtaacccgttaacccttttccccg

SEQ ID NO: 416633 - DNA, 638 bp, Homo sapiens
  misc_feature: GZ8MTXP01AXKOT.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttatgtacagcagagccggcacggccctgtgttggtatagtgtaataaagacacgtgagacggccctagagggtactcccgtgacgcgtattccgtctggcctcgacggtacgaaggggaaccaacgggttcaacgtacgttcggacccagttacgaggttcggacgtacccgagggacgagggaacggacggacggtcgtaggtaacttagtttattgtaaccgtaaataccgaaacacgaacctaacctaagtttaggttaaaccttagttcgttacgtttacgggaacgtaacgtaccggaaccgtaaacggttccgtaaccgtccgttacgggttccaccggaacccgaacggaaccccaacccgtcttacgtccttaacgtttcccg

SEQ ID NO: 416634 - DNA, 666 bp, Homo sapiens
  misc_feature: GZ8MTXP01D09N7.51.35.D02.1.454.CMB.2.raw
  modified_base (281)..(281): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcactgctctggagatgcattgaccaaacgatatgtcttattggacagcagacgccggcaggccctgtgttggngatagtaataaagacacgtgacgacggccctagagggactcccgtgaacgcgtatttcccgtcgtggcctaccgagggttaaccgaaggggtaaccgaaacgggtcaaacgtagttcgggacctagtcgaggtcggacgtccgaggacgaaggaacgggacgacgggtctaggtaacttaatttagttacgtacaaattacaaacgacgaaacctaaccgtagtttacggttaacttaagttcgttaccgttacggtaacgttaacggaccgttaaacccgtaagggttcccgaaacccgggttccgttacggggccaaccgggtaacccccgaaaacgggtaacccccaaaaccccgtcttacggttcccgaaccctttccccg

SEQ ID NO: 416635 - DNA, 629 bp, Homo sapiens
  misc_feature: GZ8MTXP01DRMVS.51.35.D02.1.454.CMB.2.raw
  modified_base (291)..(291): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgcattcgaccaaaccgtatatgtcttattggtaccagacagaacgccggcacggccctgtgttggngatagtaataaagacacgtgagacggccctagagggctccgtgagcgatttcctcgtcggctccgaggtacgaagggtaacaacgggtcaacgtagttcgggactagtcgaggtggacgtccgaggcaaggacggacgaggctaggacttagttattcgtactaaacgtcaaactacgaactaacccgtagtttacggttaacctttagttcggtaccgtttaacgggaacttaagacccgttaacgtaaacggttccgtaaacccggttcgttacgggttccgaccgaaccccgaaacggccccttaaaccccgcttacgtccttaaccgtttcccg

SEQ ID NO: 416636 - DNA, 592 bp, Homo sapiens
  misc_feature: GZ8MTXP01BGV74.51.35.D02.1.454.CMB.2.raw
  modified_base (327)..(327): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgaccaaaccgatatgcttatggtacagcagaacgccggccaggccctggtgtggtagatagtaataaagacactaggagacggccctagaggactccngacgcgtattcctcgtcggctaccgaggtacgaacgggaacaacgggtcaactagttcggaccaagtcgagtcgagtccgaggcaggacggacgaggctagaactattattagacaatacgaaacagaacacctagtttacgtaactttatcgttacgtacggtaaactcggacgttaaccgtaacggttacctacccggtcgttacggggcaccgaacccgaaacggaacccgtaaccccacgttcgtaaccaacctttccccg

SEQ ID NO: 416637 - DNA, 722 bp, Homo sapiens
  misc_feature: GZ8MTXP01DK7IH.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagccaccctcggtgtcagtcgtccccaggacaggacggccaggatcacctgctctggagatgcattgacccaaaccgatatgtcttattggtacagcagagccggcacggccctgtgttggtgatagtaataaagacacgtagaggacggccccttacggagggactccccgtaggacgcggtactttccccgtccgttcgggtcccttacccgaggggttaaccgaacggggtaaccgtaaaccgggtaccaaacgttagttcgggaccctagtccgaagggttacgggacctaccggaggaaccgaagggaaacgggacggtaacggggtctacggtaaacttagtttaacgtttcggtaactaaactttaccaaaacgaacggaacctaacccgttaagtttacggttaaacctttagttcgtttaccgttacgggaacttaacggaccgttaacccggtaaacggttccgtaaaccggttccgttcggggttaccaaccggccccgaaaccggcccctaaaccccctagttccggtccttaaccgtttccccg

SEQ ID NO: 416638 - DNA, 799 bp, Homo sapiens
  misc_feature: GZ8MTXP01AIT7X.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgtcttattggtaccagcagaacgccggcacggccctgtgtggtgtatagtaataaagacacgtgagacggcccctagagggactcccgtgagcgtacttcctcgtggtcctccgacggtacgaacggggaaccgaaacgggtaccaacgtacgttcgggacctaagtaccggtagggttacgggaacggtaccccgaaggggaccgaaaggggaaacggggacgggaacgggtcccgttaagggtaaacctttaaaggttttaacttttacgggtaaacccgttaaaacgtttaacccaaaaaccgaaacggtaaaacccgttaaaccccttaaaggttttaccggggtttaaaccttttaaagtttccgggtttacccggtttaaccgggtaaacgttaaccgggaacccgttaaacccggtaaacggggttccccgtaaaccccgggttcccggttaccggggttacccgaccccgggtaacccccggaaacccgggtaaccccccaaaacccccgtaccgttcccgggtaacccttaacccgttttcccccgg

SEQ ID NO: 416639 - DNA, 632 bp, Homo sapiens
  misc_feature: GZ8MTXP01BBKR6.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtctattggaccagcagagccggcagccctgtgtggtgatgtaataagacactgagcggccctagagggtactcccgtaggacgcgtattccctcgtggctcccgaggtaaccacggggaactaacgggtcaacgtagttcgggccctaagtcgaaggttcggacgtaccgagggacagggacggtacgagggtctaggtaacttagttagttcgtacgaagttccagacgaagaccgtagaaggttgggtaacttaggtggtaaggttgttaaccgggggacggttaaggggaacccgttaaagggttcggaacccggttccgttagggttcccgaacggtaccccgaagggccctcccggttcccccgtaacgggttccgttcccgg

SEQ ID NO: 416640 - DNA, 721 bp, Homo sapiens
  misc_feature: GZ8MTXP01A3OFW.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtacagcagagccgggcaggccctgtgtggtgatgtaataaagacactggaagacgggccctacgagggactccccgtgacggcgtacttccgtcgttcgggctacccgagggttaccgaaggggtaaccgaaacgggttcaaccgtaagttcgggaccctaagtcgaggttcggacggtcccgagggacaaggtacggggaaccgaggtcgtaggaactttagtttaaacgtttcgtaccgtaaattaccgaaaaccaacggaacctaaacctagtttacgggttaattttaacgtcggtttaccgtttaacggggaaaccttgggaacccggttaaacccgaaagggggtttccccaaacccggggtttcccgttaacgggggttccaaacccgggtaacccccgaaaaccggggtaacccccgaaaacccccccgttattacggtaaccccgttaaccgtttcccccg

SEQ ID NO: 416641 - DNA, 573 bp, Homo sapiens
  misc_feature: GZ8MTXP01AUTDQ.51.35.D02.1.454.CMB.2.raw
  modified_base (553)..(553): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggcaggccctgtgttggtgatgtataaagacactgagacggccctacgagggactcccgtgacgcgatttcctcgtggcctccgaggtcgacggggaacaacgggtcactagttcggccatcagtggaacgtcgaggcgaggaggacgagggctagactagttattgacaatcaaacagtaaccacctattggtactttatcgtacttacgggaatcgccgaaccgaaaggttccgaacccggttcgttacggggttccacggaaccccaacggcccaaacccccncttacgtaaccttccgtccg

SEQ ID NO: 416642 - DNA, 650 bp, Homo sapiens
  misc_feature: GZ8MTXP01ADMOZ.51.35.D02.1.454.CMB.2.raw
  modified_base (243)..(243): a, c, t, g, unknown or other
  modified_base (284)..(284): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgctattcgaccaaacgntatgtcttatgtacagcagacgcggcaggccctgtgtggtnatgtaataaagacacgtgaagacggccctagacgggtactcccgtaggacgcgtatttcccgtcgtcggcctacccgaggtaaccgaacgggaacctaacgggtccaactagttcggactagtcgagtggaacgtccgaaggacagggacggacgaggtctagacttaattagtgacaatacaaacgaacgactaacctagtttacggtaactttacgtgttaccgttaacggaacgttcggaaccgttaaaccgtaacgggttacctaccccgggttcgttacgggttccccgaaacggaacccccgtaaacggtaacccccaaaccccgtacggttaccgttaacccgttaaccgttttccccg

SEQ ID NO: 416643 - DNA, 706 bp, Homo sapiens
  misc_feature: GZ8MTXP01CSTYJ.51.35.D02.1.454.CMB.2.raw
  modified_base (222)..(222): a, c, t, g, unknown or other
  modified_base (240)..(240): a, c, t, g, unknown or other
  modified_base (287)..(287): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacaggacggccaggatcacctgctctgganatgcattcgaccaaacgntatgtacttattggtaccagcagaagccggcaggcccctgtgtggtnatagtaataaagacactggaagacggccctagacgggactcccgtgacgcgattccctcgtacggcttaccgaggtaccgaagggaaccgaaacgggtacaaaccgtagttcggacctaacgtcgaggttggaacgtccgagggaccgaagggaacgggaacgagggcctaggaacttaattagttacgtacaaacttaccgaaacaacggtaaaccaccgttaaagtttcggttaaacctttagtttacggttaccgttttaaacggggaaaccttcgggaacccgttaaaccggttaaacgggttcccgtaaacccgggttcccggttacgggggttaccaaaccgggtaaccccgtaaaacccgggccccctaaaaccccctcgtttaccggtaacccgttaaccttttcccccgg

SEQ ID NO: 416644 - DNA, 555 bp, Homo sapiens
  misc_feature: GZ8MTXP01DXZNK.51.35.D02.1.454.CMB.2.raw
  modified_base (458)..(458): a, c, t, g, unknown or other
  modified_base (541)..(541): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaagccggccacggccctgtgttggtgatagtaataaagacactgaagacggcccctgagggactccctgacgcgattccctcgtggcctccgaggtaccgaaggggtaaccaaacgggtccaactagttcgggaccagtcagtggacgtccgaggcaaggaggacgaggctagactattattgtacaaatcgaaanagaacctactattggtaacttatgtacttacggaactgacgacgaaggttcaccgtcgttggttcacgcccaagcccaacccngttcgtcaactccg

SEQ ID NO: 416645 - DNA, 567 bp, Homo sapiens
  misc_feature: GZ8MTXP01BSCIW.51.35.D02.1.454.CMB.2.raw
  modified_base (241)..(241): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgntatgcttattggtaccagcagaagccgggcacggccctgtgttggtgatgtaataaagacactgagcggccctcgagggactcccgtgacgcgtattcctctggctcgacggtacgagggaacaacgggtcactagttcgggacatcgaagtggacgtcgaggcaggacggacgaggctgactattattgacgtaatcaaacacgaaccaacctagtttacggtactttaatcgttacgttacgaactgacgacgtaaacggttcgtaacccggtcgttcggttcacgaacccgaacggccccaacccgcttcgtcttaacttccg

SEQ ID NO: 416646 - DNA, 807 bp, Homo sapiens
  misc_feature: GZ8MTXP01C1YN7.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccggccaggccctgtgttggtgatgtaataaagacactgagacggccctagagggactcccgtgaacgcgtactttcccgtcgttggccttaccgagggttaccaacgggggaacctaaaccggggttcaaacgtaacgtttcgggacccgtaaagtccgtaagggttcgggaacggttaccccggaaaggggacccgaaacgggaaaggggaaccgggtaggggaccttagggtaaacctttaagtttaaagttttacggtaacgtaaaacgtttaacctaaaaccgaaacgggtaaaccctaacccgttaaaggttttacggggtttaaaaccctttttaaggttaccggttttaccgtttaacccggggtaaaacgtttccgggaaacccggttaaacccggtaaacggggttaccccgtaaaccccgggtttccccggttacgggggttacccgaaacccggtaacccccggtaaaaaccgggtccccccaaaaccccccgggtactttacccgggtaacccgttaacccgttttcccccg

SEQ ID NO: 416647 - DNA, 549 bp, Homo sapiens
  misc_feature: GZ8MTXP01EAQO1.51.35.D02.1.454.CMB.2.raw
  modified_base (535)..(535): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaaccgatatgcttattggtaccagcagaagccgggccaggccctgtgttggtgatgtaataaagacaactgagacggcccctcgaaggggactccccgtggagcggatttccctcgtgggtcctcccgaagggtcaagggggaaccaacgggtcaactagttcggcccagtcgagtgggagtccagggcaaggaggacgaggctgactatttatgtataatcaaacagacaccgtagttgtacttagtgtctacggactgcgacagttcaccggtcttggttcagcccaaggccaacccnttgtccaacttccg

SEQ ID NO: 416648 - DNA, 769 bp, Homo sapiens
  misc_feature: GZ8MTXP01CVJPO.51.35.D02.1.454.CMB.2.raw
  modified_base (222)..(222): a, c, t, g, unknown or other
  modified_base (241)..(241): a, c, t, g, unknown or other
  modified_base (294)..(294): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcactgctcgtgganatgctattcgaccaaacgntatgtacttattggtaccagcaagaacgccgggccacggccctggtgttggtnatgtaataaagacactggagacggccctagagggactcccgtaggacgtcgtactttcccgtcgtcggcctaccgacggtaaccgaacgggaaccgtaaacgggtcaacgtagttcgggacctagtaccgaggttcgggaacgtacccggagggaccgaaaggggaacgggaacgggtaacgggtaccgttagggtaaacctttaagtttaaacgtttacgggttaaacgtaaaacgtttaacctaaaaacgaacggtaaaccctaaacccgttaaggttttacggtttaaaccgttttaacgttacgggtttacccgtttaccgggaaaaccgttcgggtaaacccgttaaacccgggtaaaacggttccccgtaaacccggggttcccgtttacggggttccgaacccggaaccccgaaaccggtccccctaaaccccggtacttacgtaaccccgttaaccttttcccccgg

SEQ ID NO: 416649 - DNA, 548 bp, Homo sapiens
  misc_feature: GZ8MTXP01B63YN.51.35.D02.1.454.CMB.2.raw
  modified_base (533)..(533): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgttggtgatgtaataaagacactgagaggcccctcgagggactcccgtgacgcgattcctctggctccgaggtaccaggggaacaacgggtcactagttcgggccatccgagtggagtccgaggcaggagggacgaggctagactattattgtacaagtcaacagaccacctattcggtactttatgttcttcggactgccgactacggttcgaccgtcttcgggttcacggcccaaggcccaaaccccgnttcgtcaacttcccg

SEQ ID NO: 416650 - DNA, 678 bp, Homo sapiens
  misc_feature: GZ8MTXP01EDM6E.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgtcttattggtacagcagaagcggcagccctgtgtggtgatgtataaagacactgagacggccctcgagggactcccgtgacgcgacttccgtcgtggcctccgaggtaccgaagggaaccaaacgggtcaacgtagtttcgggaccctagtacgaggtggacggtaccgacggacgaggaagggacggaaggcgtaggtacttaatttaatttaggttacgtaaacttaacctaaaccgaacggtaaaccgtaaccctaagtttacggtttaaccgttttaagttacgtttaccgtttaccgggtaaacgttaacggtacccgttaaaccggtaaacggttaccgtaacccggttacccgttcggggccgtttttaccgaacccgaaaccggaaccccgaaccccgtaccgttacgtccgttaaccgtttccccg

SEQ ID NO: 416651 - DNA, 828 bp, Homo sapiens
  misc_feature: GZ8MTXP01B12VR.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatcacctgctctggagatgctattcgaccaaaccgatatgtacttattcggtaccagcagaacgccggccaggtccctggtgttggtgtatagtataaacgacacgtgaaggacggccctacgagggtacctcccgtagacggtcgtactttcccgtcgtcggtctacccgacgggtaaccgaagggtaaccgaaaccgggtacaacgtacgttcgggacctacgtacgtaggttacggaacggttaccgacgggacgaaaggggaacggggaacgggtacgggtaccgtacgggttaaactttaacgttttaagtttacggttaaccgtaaaacgtttaaccctaaaaaccgaacgggttaaaccccttaaacccgtttaaagggttttaccggggttttaaaaccttttacggttaccggttttaacccgtttaaccggggtaaccgtttaaccgggaacccggttaaaccgggtaaaccgggttaccccgtaaccccgggtttccggttaccgggggttaccccaaacccggggtaaccccctaaaaccccggggtaacccccccaaaccccgtaccggtttccccgttaaacccgttccccgttttaaccccccg

SEQ ID NO: 416652 - DNA, 616 bp, Homo sapiens
  misc_feature: GZ8MTXP01BVAAZ.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatagtaataaagacactggagacggcccctcgagggactcccgtgacgcgattcctctggcctccgaggtacagggaacaacgggtcacagttcggcctatcaggtggacgtccgaggcaagggaggacggaggctaggacttagttaatttgtacgaaattcaaacacgaacctacccgtatttaggttacctttagtcgttaccgtttacgggaacttcgggacgacccgtaaggttccgtaacccggttccgttacgggggttccaaccggccccgaaacgggcccccaaacccccgtacgttccgtaaccttcccgtttccccg

SEQ ID NO: 416653 - DNA, 647 bp, Homo sapiens
  misc_feature: GZ8MTXP01AH2O4.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgacccaaaccgatatgtcttagttggtaccagcaaggaacggcccgggccacggtccctggtggttggtgatagtaaagtaaagactacgtggagcggccctagagggactcccgtagacgcgtacttccctcgtcggtcctccgaggtaccaggtcgaacgtaacggtcacgtagttcggactagtacaggtggacgtccgaggacgagggaaggtacgaggtctagtaacgttatttagttacggtactaaactaccgaaacaacggtaccaaccgtaagtttacggttaacttacgtcgtttaccgttacggaaacttggacccgtaaaccgacggttacccgtaacccgttcggcgggttaccgaacccggacccgaaccggccccaaaccccttcgttcgttaaccttccccg

SEQ ID NO: 416654 - DNA, 746 bp, Homo sapiens
  misc_feature: GZ8MTXP01ALVTZ.51.35.D02.1.454.CMB.2.raw
  modified_base (243)..(243): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctcgtggagatgctattcgacccaaacgntatgtacttatcggtaccagacagaagcccggcacggccctggtgtggtagagtagtaataaagacacgtagaggacggtccctacgacgggtacttcccgtagacgtcgtacgtttcctcgtcggccgtaccgaggtaaccgaacgggaaccgtaaaccgggtaccaacgtacgttaccggacctaacgtacgtacgggtacggtaacggtccggaacgggaccgaaagggaacgggaacggtagggtctaacgtaacgtttaatttagttacgtaacgtaaacgtaacccgtaaacgtaacgtaaccctaacgttacgtttacggttaaaccgtttagttcggttaccgttaccggtaacgttaaccggaaccggttaaaccggtaaccgggttacccgtaacccggttccggttaccggggttaccttacccgggtaaccccgtaaaccggaaccccctaaaccccgtcgttaccggtaacccgttaacccgtttccccg

SEQ ID NO: 416655 - DNA, 562 bp, Homo sapiens
  misc_feature: GZ8MTXP01C54OI.51.35.D02.1.454.CMB.2.raw
  modified_base (552)..(552): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaaccgatatgcttattggtaccagcagaagccgggccaggcccctgtgttggtgatgtataaagacactgagaggccctcgagggactccctgagcgattcctctggctccgaggtaccagggaacaacgggtcacgtagttcggccatcagtggagtccgaggcaggaggacgaggctagactattattgtacaatcaaactagaacaccatttggtaactttgtgttcgttacggaacttgacgaaccgtaaacggttcctaacccggtccgttgggttccacgccccgaacggccccaaccccacttcgtaaccnccgtttcccg

SEQ ID NO: 416656 - DNA, 622 bp, Homo sapiens
  misc_feature: GZ8MTXP01B5B7G.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagacgccgggccacggccctgtggttggtgatagtaataaacgacacgtgagacggcccgtcgaggggactccccgtagacgcgtactttcctcgttacggccttcccgagggtacgacggggaaccaacgggttcaacgtagttcgggcagtcgaggtggacgtccgaggacgaggaaggaccggaggctagacttaatttattcgtacgtaactacaaacacgaaccacctagtttcggttaactttagtcgttacttacggactcggacgaacgtacggttccgtaacccggtcgttcgggttccgaaccgccccgaacggtccccaacccctacgttcgtcccgttaacgtttccccg

SEQ ID NO: 416657 - DNA, 776 bp, Homo sapiens
  misc_feature: GZ8MTXP01CGR8N.51.35.D02.1.454.CMB.2.raw
  modified_base (221)..(221): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgganatgcattcgaccaaacgatatgtacttagtggtaccagcagaacgccggaccacggtccctggtgttggtgatagtaataaagacacgtgaagacggcccctagacggtactcccgtagacgcgtacttccccgtcgtacggtccttccgaggtaccgaagggaacctaaaccgggtacaaacgtacgtttacggaccctagtaccgaggttaggaacgtaccgaagggactaagggaacgggaaccgagggtcctaaggtaaccttaagtttaagttacggtaaacgtaaacgttaaccgtaaaaccaacggtaaaccgtaaaccctttaaagtttacgggtttaaaacccttttagttaccggtttaacccggtttaaccgggtaaaccgttaaccgggtaaacccgttaaacccgggttaaaccgggttacccgttaaaccccgggttcccggtttacggggttacccgaacccggtaacccccggtaaacgggtaacccccgaaaacccccttacgttacccggttaacccgttaacccttttcccccggg

SEQ ID NO: 416658 - DNA, 813 bp, Homo sapiens
  misc_feature: GZ8MTXP01A5KB4.51.35.D02.1.454.CMB.2.raw
  modified_base (240)..(240): a, c, t, g, unknown or other
  modified_base (285)..(285): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgaccaaacgntatgcttattggtaccagcagagccggccaggccctgtgttggtnatgtaataaagacactgagacggccctcgaggactcccgtgagcgtacttccctctagggtcctcccgaagggttaccgaaacggggaacctaaacggggtccaacgtaacgtttcggggaccccaaagttccgaagggtagggtaccggtacccgaaggggaccgaaagggaaacggggtaccggaaggggtacccgttagggtaaacctttaagtttaacgtttcggtaaacgtaaacttaaccaaaaccgaacggtaaaccctaaaccccgttaaggttttaacggtttaaaccgttttaaagttccgggtttacccgttttaaaccccggggaaacgtttaacgggaaaccccggttaaacccccggttaaaaggggttcccccgtaaaacccccgggtttccccgttaaccgggggggttaccccttaacccggggtaaacccccgaaaaccccgggggccccccgttaaaaaccccccccgtaccggtttaccccggtaaccccgttaaccccgtttccccg

SEQ ID NO: 416659 - DNA, 620 bp, Homo sapiens
  misc_feature: GZ8MTXP01AMZEI.51.35.D02.1.454.CMB.2.raw
  modified_base (599)..(599): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctcgtggagatgctattcgacccaaacgatatgtacttagttggtaccagcagaacgccggccaggcccctgttgttggtgatgtaataaagacactgagacggccctgagggactcccgtagacgacgtactttccgtcgtacggtcctacccgagggtaacgaacggggtaaccgtaaaccgggtacgacgtagtttcgggaccagtcgacggtagggacgtacgagggccgaagggaacgggagaacggctaggtacttagttattagtacgtaaatacaaactacgaccacgtagttacggttacttatcgtactacggaactgaccgacgtaacggttcgtaccgtcgttcggcaccgaacccgaacggcccaacccncgttcgtaaccgaacttcccg

SEQ ID NO: 416660 - DNA, 490 bp, Homo sapiens
  misc_feature: GZ8MTXP01CVOM5.51.35.D02.1.454.CMB.2.raw
  modified_base (237)..(237): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgntatgcttatggtacagcagaagccggcaggcccctgtgtggtgatgtataaagacactgagaggccctcagggatccctgagcgattcctctggctccaggtcagggcaaacggtcacatggcatcagtgagtcagcagagtacgaggctgactagttattgtcaatcaacagacaccattggtactatgtcttggaactgcgacaaggcacgtcttgggttcacgcccaggccaacccattcgtcaactccg

SEQ ID NO: 416661 - DNA, 593 bp, Homo sapiens
  misc_feature: GZ8MTXP01E4GWG.51.35.D02.1.454.CMB.2.raw
  modified_base (449)..(449): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtacagcagaagccggccaggccctgtgttggtgatgtaataaagacactggagacggccctacgagggactccctgagcgtattcctctggctccgaggtacgaagggaacaacggtcacgtattcgggcctatcgaggtggagtccgaggcgaaggacgggacgaggctagactaattatgttacaatacaaacganaacctaccagtttacggtaactttagtgttaccgttacggaactcggaccgttaaccgaaaggttcccaacccggttcgttcggggttccaaccggaaccccgaaacggaaccccaaacccccacgttctcccgaaccttcccg

SEQ ID NO: 416662 - DNA, 581 bp, Homo sapiens
  misc_feature: GZ8MTXP01COYX2.51.35.D02.1.454.CMB.2.raw
  modified_base (283)..(283): a, c, t, g, unknown or other
  modified_base (561)..(561): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacggccaggatcacctgctctggagatgcattcgaccaaaccgatatgcttatgtacagcagaagcggccaggccctgtgtggtnatgtaataaagacactagagacggccctcgagggactcctgagtcgatttccctcgtgctccgaggtacagggaacaaacggtcaactagttcggcctatcaggtgacgtccaggcaaggaggacgaggtctagacttattacttagtactaaacgtacaaacagaccacctagtttacggttaacttgttcgtacttacgggaaactcggacgaacccgtaaaggttccgaaccgtccgttacggggcaaccggaacccaaacggccccaaacccgngttcgtcccaacctttcccg

SEQ ID NO: 416663 - DNA, 535 bp, Homo sapiens
  misc_feature: GZ8MTXP01B2GIQ.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagtcaccctcggtgtcagtgtcccccaggacagacggccaggatcacctgctctggagatgcattgccaaaccgatatgcttatggtaccagcagaagccgggccaggcccctgtgttggtgatgtataaagacactgagacggccctcgagggactcccgtgagcgattcctctggctccaggtcagggcaacgggtcacattggccatcagtgagtccaggcagaggacgaggctgactattagttgtacaattcaaacagtacaccgtattggtaactttatgttcttcggaaactggacgaccgaacggttcaccgtccttgggttcacggccccaaggcccaaccccacttcgtccaacgttccg

SEQ ID NO: 416664 - DNA, 578 bp, Homo sapiens
  misc_feature: GZ8MTXP01BD67S.51.35.D02.1.454.CMB.2.raw
  modified_base (564)..(564): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaacgccggcacggccctgtgttggtgatgtaataaagacactgagacggtccctagagggactcccgtgacgcgtattcctcgtggctccgagggtcaaggggaaccaacgggtcaccgtagttcgggccctagtcgaggtggaacggtccgaagggccaaggaacgggacgagggcctagaacttattattgtacaaataccaaacacgaacaccgtatttacggtaacttagttgtacctttaggaaactgacgactaacggttcaccgtcgcgggttcacgaacccgagccccaaacccngttctccaacttcc

SEQ ID NO: 416665 - DNA, 677 bp, Homo sapiens
  misc_feature: GZ8MTXP01A1BWR.51.35.D02.1.454.CMB.2.raw
  modified_base (661)..(661): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctcgtggagatgactattcgaccaaaccgtatatgtacttagttcggtacagacgaaggaacggcccgggtaccgacggtccccgtggttcggttggtgtaagtagtaaactaaacgacacgtaggaacggacggtcccgtacggacgggtacttcccgaggacgtcgtacttccgtcgtcggtcctaccgaggtaaccgaacgggtaaccgtaacgggttaccaacgtacggttcggaccctagttacgaggtaggtacgaccgagggccgaagggacgggacgacgggtacctaggtaaactttagttagtttacgaacgtaaacgttaacaaaccgtaagaaccctaacgttagtttacgggttaaccttagttcgtacgttcggaaactcgacgaccgtagttcccgtacgtcgttggcaccggaaccaccgtcccaaccgnttcgtcaacgttcccg

SEQ ID NO: 416666 - DNA, 584 bp, Homo sapiens
  misc_feature: GZ8MTXP01D62WH.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgacccaaaaccgatatgtcttattggtaccagcagaagccgggccaggcccctgtgttggtgatgtaataaagacactgaagaggccctcgagggatccctgagcgattcctctggctccgaggtcaagggcaacgggtcaacattggccaatcgagtggagtccgaggcaggaggacgaggctgactattacttgtacaaatcaaactagaaccaacctagtttcggtaaacttttagtgttacgtttacggaactcggacgacccgtaaagggttccgaacccgttccgttggggttccacggaaccccaaacgggtccccaaaccccgacgttcgtcccgaaccgtttccccg

SEQ ID NO: 416667 - DNA, 585 bp, Homo sapiens
  misc_feature: GZ8MTXP01AT343.51.35.D02.1.454.CMB.2.raw
  modified_base (535)..(535): a, c, t, g, unknown or other
  modified_base (565)..(565): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattgaccaaacgatatgcttagttggtaccagcagaagccgggccaggccctgtgtggtgatgtaataaagacactggagacggccctgaggggactcccgtaggaagtcggtattccgtcgtggcctacccgaggtaacgaagggcgaaacgggtcacgtagttcgggaccagtcgaaggttcggaacgtccgaggacgaaggacgggtaccggagcgtagacttattattagacaatacaaacacgtaacacgtagttacggtacttatgtcttacgaacttgcgaacaacggttccgacccggtcncgggttcacgaacccgaaggtccccaaccncttacgtccgttaactcccg

SEQ ID NO: 416668 - DNA, 577 bp, Homo sapiens
  misc_feature: GZ8MTXP01BTKHI.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagagcggcaggccctgtgtggtgatgtataagacactgagacggccctacgagggactccctgagcgtactttcctcgtggcctccgaggttaccgaagggaacaaacgggtccaactagttcggcagtcgagttggacgtccgaggcgaggaggacgaggctgacttattattgtacaatcgaaacagacacctattcggtacttatcgttacgttcggaaattcggaccgttaaccgaacggttccgacccggttcgttacggggttccaccggccccgaaacggccccaaaccccacttcgtccaaccgtttcccg

SEQ ID NO: 416669 - DNA, 624 bp, Homo sapiens
  misc_feature: GZ8MTXP01DIN4L.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacaggacggccaggatcactgctctggagatgcattcgaccaaacgatatgtcttattggtaccagcagaagccggccaggcccctgtgttggtgatagtaataaagacactagagacggcccctacgagggactcccgtgacgcgactttcctcgtggctcccgaggtaccgaagggaacaaacgggtcaactagttcgggaccagtcgagttggacgtccgaaggcgaaggaaggacggaggtctaggaacttattaagttgtacgtaaatacaaacagaacaccgtagtttacggtaactttaagtgttcgttacggaacttcggaccgaacgtaaacggccgtaacccggtccgttacggggttcaaccggaaccccgaaacggaaccccaaaacccctcgttacgtaaccgttaaccgtttccccg

SEQ ID NO: 416670 - DNA, 598 bp, Homo sapiens
  misc_feature: GZ8MTXP01AT3EU.51.35.D02.1.454.CMB.2.raw
  modified_base (239)..(239): a, c, t, g, unknown or other
  modified_base (456)..(456): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattgaccaaacgntatgtcttatgtacagcagacgccggcacggccctgtgtggtgatgtaataagacactgagacggccctagagggactcccgtagacgcgtacttccgtcgtggcctaccgaggtaccgaaggggaaccaacgggtcacgtagttcgggaccctagtcgaggttggacgtacgaggacgaggaggacgaggctagacttattattgtacaatacaanacgacctactagttacggtaacttagtcgttaccttacggaacttcggaccgaccgtaaacggttccgtaaacccggttcgttacgggccaaccggaaccccaacgggccccaacccgagttcctaaccttaaccgttcccg

SEQ ID NO: 416671 - DNA, 809 bp, Homo sapiens
  misc_feature: GZ8MTXP01DWAII.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagccaccctcggtgtcaggtcgtccccaggacaggacggccaggactccacctgctcgtggagatgctattcgacccaaaccgtatatgtacttagttcggtaccagcagaacggccggccgacggccctggtcgttggtgagtgtaaataaagacacgtaggaacgaccgggtcccctacggaacggggtaccttcccgtaggaacggtcgtacgtttcccgtcgttcgggtccctacccggaacggggttaaccgaagggggtaacccgtaaacggggtccaaaccgttacgttccgggaccctagtacgtaggtcgggaacggtccgagggcgaagggaagggtacggaggtctaggtaacttagttaacgtttgtaactaaagtaccgaaaacacggtaacctaaccgtttagtttacgggtttaaaccttttagttaccggtttacccgtttaacggggtaaaccgtaacgggtaaacccgggttaaacccggttaaacgggttaccccgttaaacccggggttccccggttttaaacgggggttcccaaaacccgggtaacccccggaaaaacccgggccccctaaaaaccccccgttcgtttaccgggtaaccccttaacccgggttttaacccccg

SEQ ID NO: 416672 - DNA, 718 bp, Homo sapiens
  misc_feature: GZ8MTXP01ATKTG.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgtcttattggtaccagcagagccggcaggccctgtgtggtgatgtataaagacactgaagacggccctacgaggggtactccccgtgacgcgtattccccgtctggcctaccgagggttcaacggggaacaaacgggttcaaacgtacgtttgggaccctaattccgaagggttcggaaacggttcccgaaggggaccgaagggaacggggtaccgggaagggtccgttaaggaaacctttaagtttaagtttacggttaaccgaaacgttaccaaaacgtaacggaaccctaaaccccgtagttttaccgggttaaacctttagttcggtttacccgtttaccgggaaacgttcggaacccgttaaccgtaaaacgggttcccgtaaaccccggtccgtttacgggggaccaccgtaacccccgaaacgggaacccccaaacccgtacgttcgtaacccgttaacctttccccg

SEQ ID NO: 416673 - DNA, 606 bp, Homo sapiens
  misc_feature: GZ8MTXP01DCGVF.51.35.D02.1.454.CMB.2.raw
  modified_base (236)..(236): a, c, t, g, unknown or other
  modified_base (304)..(304): a, c, t, g, unknown or other
  modified_base (324)..(324): a, c, t, g, unknown or other
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggcaggatcacctgctctggagatgcattgccaaaccgntatgcttatggtaccagcagaagccggccagccctgtgtggtgatgtataaagcactgagaggccctnaggggtccctgagcgattcnctggctccgaggtcaagggacaacgggtcaacaagtttggaccctaactcgaaggttgggaagttcccgaaaggggacgaggaaggaacggaggtacgtagtaacttattaagttagtaactaagtaacaaacgacgaacaaccgtaacgttacgttacgttaagttacgttacgttacgtaacgtacgtaacgaaccgttaacgtaccgttaccgtaccgtcggttacgaccgaccgaaccgacccgaacccctacctacgttacctaaccgttccgtccg

SEQ ID NO: 416674 - DNA, 672 bp, Homo sapiens
  misc_feature: GZ8MTXP01ERONG.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttcctcccctcctcactctctgcacaggctctgaggcctcctatgagctgacacagcccaccctcggtgtcagtcgtccccaggacagacggccaggatcacctgctcgtggagatgcattcgaccaaaccgatatgtacttatggtaccagcagaacgccggccacggccctgtgttggtgatagtaataaagacacgtagagacggccctacgagggtactcccgtgacgcgtacttcctcgtggcctccgaggtacgagggaacaaacgggtcaacgtagttcgggacctagtccgaggtcggacgtccgaggacgaagggagggaacggagcgtagaacttattagttacgtactaaatacaaacagaacctaaccgtagtttacggttaacctttagttcggttaccgttaccggaaacgtcgtaacccggaacccggtaaaggttaccccgtaccggttcccggttaggggttaccccgaaaccggaacccccgaaacgggaacccccctaaaaccccgtccgttaccggtaacccgttaaccgttttcccccgg

SEQ ID NO: 416675 - DNA, 795 bp, Homo sapiens
  misc_feature: GZ8MTXP01DOUXI.51.35.D02.1.454.CMB.2.raw
  modified_base (222)..(222): a, c, t, g, unknown or other
  modified_base (288)..(288): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctgganatgcattgaccaaacgatatgtcttattggtaccagcagaacgccggccacggccctgtgtggtanatgtaataaagacactggaacgacggcccctacgaacggtactccccgtaggacgtcggtaactttcccgtcgtacggtcccgttaccgaacggggttaaccgaaagggggtaacccgtaaacggggttccaaaccgtacgtttcggggacccctaagtacccgtagggttacgggaaccggttacccggaagggaccgaaaggggaacggggtaaccgggacgggtaccgttaggtaaacctttaagtttaacgtttaccggtaaacgtaaacggttacccaaaaccgtaacgggtaaaccctaaccccgttaagttttacggggtttaaaccctttaagttcggtttacccgtttaacgggtaaacgttaacgggaacccggttaaaccggtaaaccgggttcccgtaaaccccgggtttcgttacgggggttaccaaccggaaccccgaaaccggggccccctaaaacccccgtgttaccggtaacccgttaacctttccccgg

SEQ ID NO: 416676 - DNA, 623 bp, Homo sapiens
  misc_feature: GZ8MTXP01CA9HK.51.35.D02.1.454.CMB.2.raw
  modified_base (310)..(310): a, c, t, g, unknown or other
  modified_base (344)..(344): a, c, t, g, unknown or other
  modified_base (356)..(356): a, c, t, g, unknown or other
  modified_base (372)..(373): a, c, t, g, unknown or other
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctgggtggaggtcggtggggggggctggtccaggcgtggggagtccctgagctctcctgtgcagcctctggatcaccttcagtacccatgaaatgcacgtgggtcccncaggcctccgaggcgaaggggctgggaggtgggnggctagttactntactatgatagggaannaaataagcactacgcagacgtccgtaggaacggcgattcgacatcctacagacgaacaacgtacgaaagtaacgttacggtttacttaactaactaaaagtacgaaacgagtacccgtagtaacggaacgttcgaagggaacggtaaccgttaacggggtctttaaccgttaggtttttaaccgcggtttaggacccgggtaaagggacgggtaaccctggtaacgttacgtaacggccgtaaaccccgg

SEQ ID NO: 416677 - DNA, 690 bp, Homo sapiens
  misc_feature: GZ8MTXP01DI47I.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcactgctcgtggagatgctattcgaccaaacgtatatgtacttagtcggtaccagacgagaacggccggaccacggccctggtggttggtagtatagtaaataaacgacacgtaggacgacggtcccctaggaacggggtactccccgtaggacgtcgtactttccccgtcgtcggtccgtaccgaggtaaccgaagggaaccgtaaacgggtacaacgtagttcgggacctagtcgaaggtggtacgttacggaggacgaagggaacgggtacgacggtacgtagtaaactttaattagttaacgtacgtaaataacaaacgtacgaaacctacctaggtttacgttacgttgtacgttacgttacggacttcgaccgttaacgtacggttccgaacccggttcgttacgggttccaacccggaacccgaaacccggtaacccctaaaccccgtgttccgtaacccttaaccgtttccccg

SEQ ID NO: 416678 - DNA, 755 bp, Homo sapiens
  misc_feature: GZ8MTXP01DD4FV.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacagacggccaggatcacctgctctggagatgcattgacccaaaccgatatgtcttattggtaccagcagaagccgggccacggcccctgtgttggtgatagtataaagacactgagacggccctcgagggactccctgacgcgtatttcccgtcgttcggctcccgagggttacccgaacggggtaacgaaacgggttccaaactagtttcgggacctagtaccgaaggttcgggaacgttcccgaaggggccgaaagggtaacggggacggaacgggtcgttacgggaaaccgttaaattttaacgttacgggtttaaccgtaaaacgtttcccgaaaaactaacgggaaacccgtaaacccttagttttacggggtttaaacccttttaaagttcggtttacccgttacggggtaaaccttaacggaccgttaaacccggtaaacggggttcccgtaaacccgggttcccgttacgggggttacccaaccgggtaacccccgaaaacggggccccctaaaaccccggtccttacggttaacccgaacccttttccccgg

SEQ ID NO: 416679 - DNA, 576 bp, Homo sapiens
  misc_feature: GZ8MTXP01BR1N6.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgatatgtcttagttggtaccagcagaacgccggcacggccctgtgttggtgatagtaataaagacactagagacggcccctgaagggactccctaggagcgtattcctcgtgggcctccgaggtccgaagggaacacgggtcactattcggccatcgagtgagtcaggcaggacggagagctagactattattgacaatacaactagacaccgtatttaggttaactttatggttacgtaccggtaacttcgacgttaccgtaaacggttcctaaccggttcgttacgggttcaccggaacccaacggcccaaccccagttcgtaaccttaacgttccc

SEQ ID NO: 416680 - DNA, 631 bp, Homo sapiens
  misc_feature: GZ8MTXP01BODUB.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaacgccggccacggccctgtgttggtgatagtaataaagacactaggaacgacggtcccctacgagggtactcccgtagagtcgtactttcctcgtgcctccgaggtaccgagggaacaacggtcactagtcgacatacgaggtgacgtcgaggacgaaggagggacggagtcgtagtaacttagttaagttcgtaacgaaacttaaccgaacgaacgtaaccacgttacgttagtttaaccttagttcgtacgttaccggaacgtcggaccgttaaccggtaaaccgttccgtacccgtcggttaccggttcgaccgaacccgaacccgaacccctaacccgtacgttccgtaaccttcccgtttccccg

SEQ ID NO: 416681 - DNA, 689 bp, Homo sapiens
  misc_feature: GZ8MTXP01DN3ZL.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtggagatgcattcgacccaaacgattatgtacttagttggtaccagacaggaacgccggccgacggcccgtgtgttggtgtatagtaataaagacacgtggagcggccctagagggacttccgtagacgcgtactttccgtcgtcggtcctccgtaggtaaccgaagggtaaccgaaacggtcaactagtcgacctagtacgagtggacgtaccgaggacgaaggacgggacgaggtctagtaacttagtttagttacgtataaactacaaaacgaacgtacctaaccgttagtttacggttaaacctttagttcgtttaccgttaacgggtaacgttaacggacccgttaaaccggtaacggttcccgtaacccggttccggttaccggggttccaacccgggtaaccccgaaacccggaaccccctaaaccccgtcggttacccgtaaccttaacccggtttcccccg

SEQ ID NO: 416682 - DNA, 704 bp, Homo sapiens
  misc_feature: GZ8MTXP01DP46E.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattgaccaaaccgatatgtacttattggtaaccagacagaacggccgggccacggccctggtggttggtgatagtaataaagacacgtaggagacggccctacgagggactcccgtagacgtcgactttccgcgtcggcctcccgtacggtaaccgaacgggaacgaaccgggtcaacgtagttcgggactagtcgaggtaggtacgtccgaggacgaagggaacgggacggaacggtcgtaggtaacttaagtttagttacgtacgtaaaacgttaccgtaaaacctaacgaacctaaccgttaacggttttaggtttaaaactttcgttaacggtttccgttaaccgggtaaacttcggaacccgttaaaccggtaacgggttccctaacccgggttccgttacgggttcccgaaaccggtaaccccgaaacggccccaacccgtacttccggttaaccttaacccggtttccccg

SEQ ID NO: 416683 - DNA, 674 bp, Homo sapiens
  misc_feature: GZ8MTXP01E17O1.51.35.D02.1.454.CMB.2.raw
  modified_base (223)..(223): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtgganatgctattcgaccaaacgtatatgtcttagttacggtaccagacaggaacgccgggaccgacggccctggtgttggtgatagtataaagacacgtgagacggcctacgacggactcccgtgagacgtacttccctcgtggctcgaggtacgacgggaaccaacgggtcacgtagttcgggaccagttacgagtggaacgtacgacggacgagggaacgggacggacggccgtagtaacttagtttagttgttacgaaacttacaaacaacgaacctacctacgtttaggttaacctttagttcgttaccgttacggtaacgtcggtaaccgttaaaccggtaaacggttccgtaaacccggttccggtttacggggttcccgaccgaaccccggaaaccggtaacccccaaaaccccgtaccgttaccgtaacccgttaaccgttcccccg

SEQ ID NO: 416684 - DNA, 633 bp, Homo sapiens
  misc_feature: GZ8MTXP01BSSVV.51.35.D02.1.454.CMB.2.raw
  modified_base (241)..(241): a, c, t, g, unknown or other
  modified_base (479)..(479): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctctggagatgcattcgaccaaaccgntatgtcttattggtaccagcagaagccgggccacggccctgtggttggtgatgtaataaagcactgagacggccctgagggactcccgtgacgcgtattcctcgtggcctccgaggtacgacgggaacaacgggtcaacgagtttcgggaccctaagtccgaggttcggacgtccgagggcaagggacggacggaggtcgtagtaaccttagtttagttagtacgtaaataccaaacncgaaccaccgttagttacggttaactttagttcggttcttacgggaaccttgggaccgaccgtaaacggttcccgtaacccggttccgttggggttcccacggaaccccgaaccggcccctaaaaccccgtgttccgtccttaaccgttccccg

SEQ ID NO: 416685 - DNA, 704 bp, Homo sapiens
  misc_feature: GZ8MTXP01CRLCG.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctggtgtcagtcgtccccaggacagacggccaggatcactgctctggagatgcattcgaccaaacgntatgtcttattggtacagcagaacgccggccacggccctgtgtggtgtatagtaataaagacactggaagacggccctagacgggactcccgtagacgcgtattccctcgtgctaccgaggtacgagggtaaccgaacgtcaacgtacgtcggacctagtcgaaggttcggacgtaccggagggaccgaagggaacggacggacgggtaccgttaggtaacgtttaattaagtttacgtaacgtaaacttaaccgaaacaacgggaaccctaaaccgttaagtttacgggtttaaaccttttacgtacggtttacccgttaaaccgggtaacgtaacggtaacccgaaccggttaaacggttacccgtacccgggttccgttaccgggttccgaacccggtaacccgtaaacccgggcccctaaaacccccgtcgttaccggtaacccttaaccgtttaacccccg

SEQ ID NO: 416686 - DNA, 710 bp, Homo sapiens
  misc_feature: GZ8MTXP01EE5H6.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacggccaggatccacctgctcgtggagatgctattcgacccaaaccgatatgtacttagtcggtaccagcaaggaacgccgggccacggccctgtgttggtgtatagtaataaagacacgtaggaggacggtccctacggaagggtaccttcccgtaggacggcgttacttccctcgtcggcctacgagggtaaccgaacgggaaccgtaaacgggtacaacgtagttaccgggacctagtacgaggtaggtacgacgaggacgaggaacgggacggtaggtcgtacggtaacttagttacgtttacgtaacgtaaacgttaacgaaacaacggtaacccaacgtttacgttttacggttaaactttacgttcggttacccgttaacgggtaaccgtaacggacccgttaaacggtaaccggttccgtaaacccggttcggttacgggaccaaccggaaccccgaaacggtccccaaccccgtagttcctaaccgttaaccgttttcccg

SEQ ID NO: 416687 - DNA, 630 bp, Homo sapiens
  misc_feature: GZ8MTXP01A9GV6.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgtcttattggtaccagcagaagccgggcacggccctggtgttggtgatgtataaagacactgagacggccctagagggactcccgtgacgcgtattccctcgtggctccgaggtacgagggaacgaacggtcactagttcggcatcgagtggagtccgaggcgaggacgggacgaggctagactaattagttgaacaatacaacagaacctacctagttacggttaactttagtcggttaccttacgggaacttaacgggtaccgttaaaccggtaacgggttacccgtaccccgggtccgtttacgggggttacccacccggtaaccccgaaaccgggtaacccccaaaccccgtacgttccggtaacccttaaccgtttccccg

SEQ ID NO: 416688 - DNA, 598 bp, Homo sapiens
  misc_feature: GZ8MTXP01BKDDT.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccggcaggccctgtgtggtgatgtataaagacactgagacggccctgaggggtactccccgtgaggcgtattccctcgtggcctcgaggtcgagggtaaccaacgggtccactagttcggaccagtccgagttggacgtccgaaggcaggagggacgaggctagacttattattcgacaaatacaaacacgacaccgtagttacggttaacttagtcgttcgttacggtaactcggaccgaaacccgtaaagggttcccgtaacccggttcgttacggggttccaccggaaccccgaaacggcccctaaaccccgcttacgtccaactttccccg

SEQ ID NO: 416689 - DNA, 660 bp, Homo sapiens
  misc_feature: GZ8MTXP01DVOIJ.51.35.D02.1.454.CMB.2.raw
  modified_base (242)..(242): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgtcttattggtaccagcagaagccgggccaggccctggtgttggtgatgtaataaagacacgtgaagacggccctagacgggatcccgtgagcgatttcctcgtaggctccgaggtacgagggaacgtaaacggtcaacgagttcgctaagtcagtggagtccgaggcgagagggacgaagctgactattagtgtacaatcgaaacagaccgtacctagtttacggttaaactttacgttagttaccgtttacggaaacgtggtacccgttaaaccgtaaaccgggtttcccgtaacccggttcccggttacggggggttccaaaccccgggtaacccccggtaaaacccggggaaccccctaaaaccccccgtaacgggtttcccgttaaccccgttaaccgtttttccccccg

SEQ ID NO: 416690 - DNA, 734 bp, Homo sapiens
  misc_feature: GZ8MTXP01E1H6T.51.35.D02.1.454.CMB.2.raw
  modified_base (282)..(282): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggccaggatcacctgctctggagatgcattgaccaaacgatatgtcttatggacagcagacgccggcacgcctgtgtggtnatgtaataaagacacgtgagacggcccctacggacgggactccccgtaggacgtacgtactttcccgtcgtacgggtcctccggaagggtaccggaacggggtaacgtaaaccgggtccaaccgttaaggtttccgggaccctaaagtccgaaggttcgggaacgtaccgaggacggaacggtaaggggaccggtagggaccgttaggtaccttaaatttacgttacggtaaccgtaaagttaacccgaaaacttacggaaaccttaaaccgtagtttaacgggtttaaacctttaggtccgttaccgtaaccgggtaaacgtcggaaccgttaaaccggtaaacgggttcccgtaacccgggttccggttacgggggttccaacccggtaaccccgtaaaccgggccccctaaaacccccggtatttccggaaacccttcccgtttccccg

SEQ ID NO: 416691 - DNA, 697 bp, Homo sapiens
  misc_feature: GZ8MTXP01BCZSN.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgactattcgacccaaaccgtatagtcgtcttagttcggtaccagacgagaacggccgggccacggcccctaggtcggttggtgtagtaggtaataaacgacacgtaggacggacggtccctacggaacgggtactccccgttagacgtcgtactttcccgtcgtacggtcctaccgtacggtaaccgaagggaaccgtaaccgggtacaacgtagttcggaccagtcgagtggacgtaccgaggacgagggaacggacggacggtctagtaacttaagtttagttacgtaacgaactaacgaaacacgtaacctaaccgtagtttacgttaaccgtttagtcgttacgttaccggaacgtaacggaccgttaaaccgtaacggttccgtacccggttccggttagggttaccaccggaacccgaccggaacccctaaacccgtcgttcctaacccttaacgtttccccg

SEQ ID NO: 416692 - DNA, 622 bp, Homo sapiens
  misc_feature: GZ8MTXP01ETZT4.51.35.D02.1.454.CMB.2.raw
  modified_base (282)..(282): a, c, t, g, unknown or other
  modified_base (288)..(288): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggacagcagacgccggcaggccctgtgtggnatgtanaaagcacgtgagacggccctgaggtctccgtgagcgattccctcgtgctccgaggtcgaagggcaacgggtcacgtattcgggacagtacgaggtggacgtcgaggcgaaggtacggacggaagggtctagaacttagtttattacgtactaaacgtacaaaacgacgtaacctaaccgtagtttacggttaacctttaagttcgttaccgtttacggaattaacggtcggttaaaccgtacggttaccgacccggttaccgttcggggttaccaccgggaaccctaaaccggcccctaaaccccagttaccgtaaccgttaaccgtttccccg

SEQ ID NO: 416693 - DNA, 614 bp, Homo sapiens
  misc_feature: GZ8MTXP01AO579.51.35.D02.1.454.CMB.2.raw
  modified_base (463)..(463): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtcccccaggacaggacggccaggatcacctgctctggagatgctattcgaccaaaccgatatgtcttattggtaccagcagaacgccgggcacggccctgtgttggtgatgtaataaagacactgagaggccctcgagggactcccgtgacgcgtattccctcgtggcctccgaggtaccgaagggcaaacgggtcaacgtacttcgggacctatccgagttggacgtccgaggccaggacggacgtagggactagacttagttattgacgaatacaanacgacacctagttggtacttagtcttacgttaccggaaacttcgaaccgttacgtaaacggttccgtaacccggtacgttccgggcaacccggaacccgaaccggaaccccaaacccccgacttcggtaaccccgttaacgtttccccccg

SEQ ID NO: 416694 - DNA, 684 bp, Homo sapiens
  misc_feature: GZ8MTXP01BBJV2.51.35.D02.1.454.CMB.2.raw
  modified_base (242)..(242): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgacccaaaccgntatgtcttagttggtaccagcagaacgccggccacggccctgtgttggtgatagtaataaagacacgtaggaaggacggtcccctacggaacggggtacttccccgtagacgtcgtactttcccgtcggtggcccgtaccgaggtaaccgaacgggaacgaaaccgggtcaacgtagttcgggacctatcgaggtggacgtccgaggacgaggacggaccgaggtctagtaacttattattacgtacgaaacttacaaacacgtaacctaaccgttagtttacggttaactttagttcgttaccgtttacggaactcggtaaccgaccgtaacgggttccgtaacccgggttccgttaccgggggttccaacccggaaccccgaaaccgggaaccccctaaaaccccgtccgttaccggtaacccgttaaccgtttcccccg

SEQ ID NO: 416695 - DNA, 657 bp, Homo sapiens
  misc_feature: GZ8MTXP01AX7BO.51.35.D02.1.454.CMB.2.raw
  modified_base (287)..(287): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgctattcgaccaaaccgatatgtcttatggtaccagcagagccggcacggccctgtgttggtnagtgtaataaagcactagagacggcccctgagggtactcccgtgacgtcggtactttcccgtcgtcgggtacctacccggagggttacgaacggggtaaccgaaaccggtcaacgtacgtttcgggaccctaagtacgacgggttagggacggtcccgaagggcgaacgggaacgggacggaacgggtcctaggtaacttaattagttgtaacgaactacaacaacgtaccaactagttacggtaactttgtacgttctacggtaactgaccgttaacgtacggttacctaacccggtccggttacgggccgaccgtaaccccgacggaaccccaaccccgtaggttcctaacccgttaaccgttccccg

SEQ ID NO: 416696 - DNA, 685 bp, Homo sapiens
  misc_feature: GZ8MTXP01A2A4H.51.35.D02.1.454.CMB.2.raw
  modified_base (239)..(239): a, c, t, g, unknown or other
  modified_base (279)..(279): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgtcttatgtacagcagagccggcagccctgtgtggtnatgtataaagacactgagacggccctacgaggactcccgtgagcgtattccctcgtggctaccgaggtacgaacgggaacgaaacgggtcaacgtagttcgggaccctagttccgagggttacggacggtacccgagggaccgaagggaacggggaacggaagggtcgttacggaaccgttaatttaagttaggtacgtaaacgttacgaaaactaaccggaactaacccgtagtttacggttaaccttagttcggtttacttaccgggtaaaccgtggaacccggttaaaccgtaaaccgggttaccgtaaccccggtttccgttacggggttccgaaccggaaccccggaaaccggtaacccccaaacccctacgttacggtaacccttaaccttttaaccccg

SEQ ID NO: 416697 - DNA, 707 bp, Homo sapiens
  misc_feature: GZ8MTXP01EON70.51.35.D02.1.454.CMB.2.raw
  modified_base (222)..(222): a, c, t, g, unknown or other
  modified_base (241)..(241): a, c, t, g, unknown or other
  modified_base (287)..(287): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctggtgtcagtcgtccccaggacaggacggccaggatcacctgctctgganatgcattgaccaaacgatntgtcttatggtacagcagacgcggcagccctgtgtggtgatgtaanaagacactggagacggcctacgagggtactcccgtgagtcgtactttcccgcgtggcctcgacggtaacgaacgggtaacgaacgggtacaactacgttcgggaccctagtacgtaacggttcgggaacgttcccggaagggaccgaaaggggaaacggggtaccggtaaaggggtcctaaggtaaaccgtttaatttagtttacggttaacgaaacttaaccggaaaactaaccggaaacctaccgttaacgtttaggtttaaaacctttagttaccgtttacggttaaccggaaccttaaggggacccttaaaccggtaaaccggttccgtaaacccgtttccggttacgggttaccgaaccgaaccccgaaacggtcccccaacccgtacttcggttaacccgttaaccctttcccg

SEQ ID NO: 416698 - DNA, 705 bp, Homo sapiens
  misc_feature: GZ8MTXP01A0CMY.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctcgtggagatgcattcgacccaaaccgattatgtacttattcggtaccagcagaagcccggcacggccctgtggttggtgatgtaataaagacacgtgaacgcggcccctagacgggtactcccgtgaacgcggtactttccgtaccgtcggtcctaccgacggtacggaacggggaactaaacgggtcaaacgtattcgggaccagttaccagggttacggacgttacccggagggaccaaggggaacgggtaccgaggggtacctaggtaacctttaagtttaagtttacggaacctaaacgttaccgaaaactacggaacctaaccgttacggtttaaggttaaacctttagttccggttactttaacccgggattaacggaccggttaaaccgtaaacgggttccgtaaccccggttcgttcgggaccacccggaacccaacgggccccaaaaccccgttcttacgttaaccgaacctttccccg

SEQ ID NO: 416699 - DNA, 742 bp, Homo sapiens
  misc_feature: GZ8MTXP01BP499.51.35.D02.1.454.CMB.2.raw
  modified_base (224)..(224): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgacattcgaaccaaacgtatatcgtacttagttcggtaaccagcgaaggaacggcccgggaccgaaccgggtcccctggttcggttggtagtagttagtaaagtaaaacgacgtacgtggaaggaccgtaccccgtagaagggtacctccgtagacgcttacttccctcgtgtccgtaccgacggtcggaaacgggaaccgtacggtccaacttacggttccgaccgattacggtaacgggtcggtacgtacccggaaggaccgaagggaaacggggtaccggaggtacccgttaggtaaactttaagttaacgtttactaaacgtaaacttaacccggaaaactacggtaaaccctaaccttaaggtttacgggttaacttttaacgtccgtttaccgtaacggtaacgtccggtaaaccaaccgggtagttacccgtcccgttcgggttacggttaccaccgaacccgaaaccggcccctaaaccctgttccgtaacccgttaaccgttccccg

SEQ ID NO: 416700 - DNA, 693 bp, Homo sapiens
  misc_feature: GZ8MTXP01DJAAP.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattcgacccaaaccgatatgtacttattggtaccagacagaacgccgggccacggccctgtgttggtgatagtaataaagacacgtagagacggccctacgagggactcccgtgacgcgtacttcctcgtggctcccgaggtaccgaagggaacgaacggtcaactagttcggcctatcgaggttggacgtccgagggacaaggaacgggacggaaggtcgtacgaacttaagtttagttacgtaacgtaaacttaccgaaaacacggtaaacctaacccgtagttttacgggttaaacctttaagttccggtttacgtttaccgggaaaccttaaggacccggaaaccgttaaacgggttacccgttaacccgggttccggttacggggttcccaaaccgggtaacccccgaaaacgggccccctaaaaccccgacgtttaccgtaaccgttaacccttttccccgg

SEQ ID NO: 416701 - DNA, 612 bp, Homo sapiens
  misc_feature: GZ8MTXP01CXIQ2.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcactgctctggagatgcattcgaccaaacgntatgcttatggtaccagcagaacgccggccacggccctggtgtggtgatagtaataaagacacgtgagacggccctgaggactccgtgacgcgtattcccgtcgtggctccgaggtacaacggggcaacgggtacactagttcggacctagtcgaggtggacgtccgagggacaggaggacggaggctagacttagttattcgtacaagtacaaactacgaacacctagtttacggtaactttagttacgttcgttacgggtaaactcggtaaccgaaccgtaaaggttcccgtaaccggttccggttacggttcgaccggaaccccaaacggaaccccaacccctacgttcgttaacccgttaacctttcccg

SEQ ID NO: 416702 - DNA, 759 bp, Homo sapiens
  misc_feature: GZ8MTXP01BMJYT.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgacccaaaccgatatgcttattggtaccagcagaagccgggcacggccctgtgttggtgatgtaataaagacactgaagacggcccctcgaggggactcccgtggagcgtattccctcgtggcctccgaggtaccgaagggaacaacgggtcacagttcgggacctatcgaaggtgggacgtacccggagggacgagggaacgggacggtagggctacggtaacgttaagtttagtttacggtactaaacgttaccaaaacgtacggtaaacctaaccccgtagttttaccgggtttaaacgttttaacgttcgggtttacccgtttaccgggtaaacccggttaacgggtaaccccggttaaaccccggttaaaaccgggggttccccgtaaaccccgggtttcccccggttaacggggggttaccccttaaaccggggtaaccccccgaaaaacccgggggtcccccctaaaaacccccccgtaccggttacccgggttaaccccgttaacccctttttaacccccgg

SEQ ID NO: 416703 - DNA, 855 bp, Homo sapiens
  misc_feature: GZ8MTXP01APE3N.51.35.D02.1.454.CMB.2.raw
  modified_base (246)..(246): a, c, t, g, unknown or other
  modified_base (293)..(293): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatccacctgctcgtggagatgctattcgaccaaaccgtntatgtcttatggtaccagcagaacgccggccacggccctgtgtggtnatagtaataaacgcacgtaggacgacggtccccgtacgacggggtactcccgtggacgcggtactttcccgtcggttcggtaccttaccggacggttaacccgggaacgggtaacccgtaaaccggggttaccaaccgtttaacggtttaccgggaccgtaacgttacccgggtaacggggttacggtaacccgggttacccggtaacggggtaacccgaagggggtaaacgggggaaccgggttacgggaccccgttaagggtttaaacctttaaaccgttttaaggtttaacggtaaccgtaaaacggtttaaccaaaacccgtaacggtaaacccttaacccgttaaggttttaacgggtttaacccttttaaagtcccgggttttaaccggttaaaccggtttaaccggccgtaaacccggttaaaccgggtaacccgggttaccgttaacccggttacccgggttacgggggttacccaaccgggtaacccccgaaacggttaacccccgtaaaaccccgtacgttaccggtaaccccgttaacccgttttcccccg

SEQ ID NO: 416704 - DNA, 724 bp, Homo sapiens
  misc_feature: GZ8MTXP01AZ257.51.35.D02.1.454.CMB.2.raw
  modified_base (240)..(240): a, c, t, g, unknown or other
  modified_base (690)..(690): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatgtaccagcagaagccggccacggccctgtgttggtgatgtataaagacactgagaggccctagagggtactcccgtggacgcggtacttccctcgtggcctcccgaggtacgaacggggaacacgggtcactagttcgggacctataccgagttagggacgtacccgaagggaccgaagggaacgggaccggaaggggtcctagggtaaaccttaagtttaacgtttacggttaacgaaacttaccgaaacgtaacggaaccctaaacccgtaagtttacgggtttaaacctttaacggttcggtttaacccgtttaccggggaaaaccttcgggaaccccgttaaaccgggtaaaccggttcccgtaaccccgggttaccggttacggggttaccgacccgggtaaaccccggtaacgggaacccccaaaacccccggtnttacccgggttaacccgttaacccttttccccgg

SEQ ID NO: 416705 - DNA, 730 bp, Homo sapiens
  misc_feature: GZ8MTXP01D4T45.51.35.D02.1.454.CMB.2.raw
  modified_base (224)..(224): a, c, t, g, unknown or other
  modified_base (294)..(294): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattcgaccaaaccgtatatgtcttatggtacagacaaggaacgccggcacggtccctgtcgttggngatagtaataaagactacgtaggaacgacggtcccgtacgaaggggtacctcccgttaggacgtaccgtactttccccgtcggtacggtcccgttaccggaacgggtaaccgaaacggggtaacccgtaaacggggtacccaacgttaacgttcgggaccctagttaccgaggtcgggaacgtcccgagggacaaggggaacggacggagtcgtaacgattaagtttattacggttaacaaacttaccgaaaacgtaacgaaccctaaccgttaagtttacggttaaacttttagtacggttaccgtttaaccgggaacttccggaaccgttaaacccgtaacgggttccgtacccggttcgttacggggacaacccggaacccgaaaccggtaaccccaaacccctacgttccgtaacccttaaccgtttccccg

SEQ ID NO: 416706 - DNA, 623 bp, Homo sapiens
  misc_feature: GZ8MTXP01AZLTE.51.35.D02.1.454.CMB.2.raw
  modified_base (287)..(287): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctggagatgcattcgaccaaacgatatgtcttattggaccagcaagacgccggcacggccctgtgtggnatgtaataaagacacgtagagacggccctagaagggtctcccgtgacgcgtacttccgtcgtggcctaccgagggtaccgaaggggtaaccaacgggtcaactcgttcggacaatcgaggtcggacgtccgaggcaaggaggacgaggtctagacttagttatgtacaatcaaacgtagaacctaccgtagtttacggttaacttagtcgttacgttaacggaactcggaccgaaccgtaacggttccgtaacccggttccgttacggggttccaaccggtaaccccgaaacggaacccctaaaccccgtcgttaccgtccttaaccgtttccccg

SEQ ID NO: 416707 - DNA, 714 bp, Homo sapiens
  misc_feature: GZ8MTXP01BRK0A.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccgaggactcacctgctcgtaggagatcgctatcgaaccaaacgtatatgtacttagttcggacagcgaagaacggccggacccgacggtcccgtggttacggttggtagtaagttagtaaacgtaaaacgacgtaacgtacggaacggtacccgggtaccccttacgggaagggtacctccccggttagaacggtcgtacgtttcctacggtcggtacctacccggtacggtaaccggaacgggaaccgtaaccgggtacaaccgttagtttaccggacctaaatcgtacgtaggtacgtacggacggacgaagggtaacgggaccgtaggtcgtacgttaacttaagttaagttcgtaacgtaaactaccggaaaacacgtaaccaaccgttagttacggttaaccttgtacgttactaacggattcgaacttaccgtaagcccgtaaaccgtgacgggttcaccgtaacccgaccggaacccacccgagttaccgcttaaccgtttcccg

SEQ ID NO: 416708 - DNA, 477 bp, Homo sapiens
  misc_feature: GZ8MTXP02HCUXI.51.35.D02.1.454.CMB.2.raw
  modified_base (237)..(237): a, c, t, g, unknown or other
  modified_base (408)..(408): a, c, t, g, unknown or other
  modified_base (449)..(449): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggccctgtgtggtgatgtataaagacactgagaggccctgagggatccctgagcgtattcctcgtggctccaggtcagggacaacggtcacattggccatcagtgagtcaggcagagacgagctgactatatgtacatcaanagacacattgtactatgtctgactgacacaaggtcacgtcncggtcacgccgagccacccatcgcactc

SEQ ID NO: 416709 - DNA, 496 bp, Homo sapiens
  misc_feature: GZ8MTXP02J12O8.51.35.D02.1.454.CMB.2.raw
  modified_base (237)..(237): a, c, t, g, unknown or other
  modified_base (305)..(305): a, c, t, g, unknown or other
  modified_base (409)..(409): a, c, t, g, unknown or other
  modified_base (459)..(459): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgctatggtaccagcagagccggcaggcccctgtgtggtgatgtataaagacactgagaggccctnagggatccctgagcgattcctctggctccaggtcagggcaacggtcacattggccatcagtgagtccaggcagaggacgaggctgactattattgtcaatcaanagacaccattggacttatgtcttcggaactgacgaccaaggtcaccgtcngggtcagcccgaacggcccaacccactcgtcactccg

SEQ ID NO: 416710 - DNA, 493 bp, Homo sapiens
  misc_feature: GZ8MTXP02GR743.51.35.D02.1.454.CMB.2.raw
  modified_base (237)..(237): a, c, t, g, unknown or other
  modified_base (311)..(311): a, c, t, g, unknown or other
  modified_base (459)..(459): a, c, t, g, unknown or other
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctnagggatccctgagcgattcctctggctccaggtcagggcaacggtcacattgccatcagtgagtccaggcagagacgaggctgactattatgtcaatcaacagacaccattggtacttatgtctcggaactgcgacaaggtcacgtcncgggtcagccgaaggccaacccgactcgtcactc

SEQ ID NO: 416711 - DNA, 497 bp, Homo sapiens
  misc_feature: GZ8MTXP02JKVFT.51.35.D02.1.454.CMB.2.raw
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgtggtgatgtataaagacactgagaggccctcaggggatcccctgagcgattcctctggctccaggtcagggacaacggtcacattgccatcagtgagtccaggcagagacgaggctgactattatgtacaatcaacagacaccattcggtacttatgtcttggaactgacgaccaaggtcacgtctcggtcagcccaaggcccaacccgctcgtcactc

SEQ ID NO: 416712 - DNA, 491 bp, Homo sapiens
  misc_feature: GZ8MTXP02G7OJ6.51.35.D02.1.454.CMB.2.raw
  modified_base (238)..(238): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtacagcagagccggcaggcccctgtgtggtgatgtataaagacactgagaggccctcgagggatcccgtgagcgtattcctctggctccaggtcagggcaacggtcacattgccatcagtgagtcaggcagaggacgagctgactattattgtacaatcaacagacaccattggtacttatgtctcggaactgcgacagtcaccgtccgtggtcagcccgaaggcccaacccatcgcactcc

SEQ ID NO: 416713 - DNA, 505 bp, Homo sapiens
  misc_feature: GZ8MTXP02IO3CS.51.35.D02.1.454.CMB.2.raw
  modified_base (238)..(238): a, c, t, g, unknown or other
  modified_base (395)..(395): a, c, t, g, unknown or other
  modified_base (411)..(411): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggccccctgtgttggtgatgtataaagacactgagaggccctcagggatccctgagcgattcctctggctccgaggtcagggcaacgggtcacattggcatcagtgatcaggcagagacgaggcngactattatgtcaatnaaacagacaccattggtacttatgtctacggaactgacgacaaacgtcaaccgtcctcgggtacagcccaaggcccaaccccgatcgtcactcc

SEQ ID NO: 416714 - DNA, 503 bp, Homo sapiens
  misc_feature: GZ8MTXP02JLLZP.51.35.D02.1.454.CMB.2.raw
  modified_base (238)..(238): a, c, t, g, unknown or other
  modified_base (283)..(283): a, c, t, g, unknown or other
  modified_base (496)..(496): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgttggngatgtataaagacactgagaggcccctgagggatcccgtgagcgattcctctggctccaggtcagggcaacggtcacattgccatcagtgagtccaggcagagacgaggctgactattattgacaatcaacagacacattggtacttatgtcttacggaactgacgacgaaacgtcaccgtcgtcggtacacgccgaacgacccacccgatcncactccg

SEQ ID NO: 416715 - DNA, 527 bp, Homo sapiens
  misc_feature: GZ8MTXP02JDEW0.51.35.D02.1.454.CMB.2.raw
  modified_base (238)..(238): a, c, t, g, unknown or other
  modified_base (279)..(279): a, c, t, g, unknown or other
  modified_base (306)..(306): a, c, t, g, unknown or other
  modified_base (409)..(409): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtacagcagaagccggcaggcccctgtgtggngatgtataaagacactgagaggccctnagggactccctgagcgattcctctggctccaggtcagggcaacggtcacattgccatcagtgatccagcagagacgaggctgactattattgtacaatcaaanagacaccgtattaggtacttaatgttacttacggaaacttggaccgaaccaaacgggtccaaccggtccctaggggaccacgccccgaaacggaccccaacccacgtcgtacacttcc

SEQ ID NO: 416716 - DNA, 550 bp, Homo sapiens
  misc_feature: GZ8MTXP02JODOZ.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggcaggcccctgtgtggtgatgtataaagacactgagacggcccctagagggactcccgtagacgcgtattccctcgtgctccgaggtcgagggaccaacggtcactagttcggaccatcagtggacgtccgaggcaggaggacgagctagactattatgtacaatacaacacgacaacctagttagtacttagtgttacgtacgaactcgaccgaacgacggtaccaccgtccgtacgggtcaccgcccgaacggccccaaacccactcgtacctaccttcccg

SEQ ID NO: 416717 - DNA, 550 bp, Homo sapiens
  misc_feature: GZ8MTXP02IM7UT.51.35.D02.1.454.CMB.2.raw
  modified_base (238)..(238): a, c, t, g, unknown or other
  modified_base (411)..(411): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtacagcagaagccggcaggcccctgtgtggtgatgtataaagcactgagaggcccctgagggactccccgtgagcgattcctctggctccaggtcagggacaacggtcacattcggcatcagtgagtccaggcagagacgagctgactattatgtcaatcaanagaacacctagttacggtacttatgttacttacggaacttcggacgaaccgaaacggtccaaccggttcccgtacggggttccaacggaacccccgaaacggaccccaaacccccgaactccgttaccaacctttcccg

SEQ ID NO: 416718 - DNA, 586 bp, Homo sapiens
  misc_feature: GZ8MTXP02JIBBB.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctgagggactcccgtgagcgtattcctctggctccgaggtcgagggacgaaacgggtcaactagttcggacctatcagttggagtcccgaggacaggagggacgaggctggacttatttagttgtacaaatacaaacagaacctaaccattacggtacttagtgttaccgttacgggaactcggaccgaaccgtaacggtcctaacccggtccgtacgggtaccaacggccccgaaacggaccccgaaaacccctacgtcgtacctactttcccg

SEQ ID NO: 416719 - DNA, 553 bp, Homo sapiens
  misc_feature: GZ8MTXP02IP3VM.51.35.D02.1.454.CMB.2.raw
  modified_base (238)..(238): a, c, t, g, unknown or other
  modified_base (278)..(278): a, c, t, g, unknown or other
  modified_base (476)..(476): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaacgntatgcttatggtacagcagaagcggcaggcccctgtgtgngatgataaagcactgagaggccctgagggactcccgtgagcgattcctcgtggcctccgaggttccgaaggggaccaaacgggttccaacgtactttcggggacccaatccgaaggttggaacgttcccgaagggccaaggaggaccgaagggcttagactattattgtacaatcaacagacaccattggtacttagnttacgtcggaactcgacgaaccagggtaccaccgtcgtacggtcacgccgaacggaccaccccgatcgtcacttccg

SEQ ID NO: 416720 - DNA, 491 bp, Homo sapiens
  misc_feature: GZ8MTXP02I3C3W.51.35.D02.1.454.CMB.2.raw
  modified_base (239)..(239): a, c, t, g, unknown or other
  modified_base (415)..(415): a, c, t, g, unknown or other
  modified_base (461)..(461): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctcagggatccctgagcgattcctctggctccaggtcagggcaacggtcacattggcatcagtggagtccaggcagagacgaggctgactattattgtcaatcaanagacaccattggtacttatgtcttggaactgcacaaggtcacgtcnggtcagcccgaagccaacccatcgcacttc

SEQ ID NO: 416721 - DNA, 489 bp, Homo sapiens
  misc_feature: GZ8MTXP02JUSEQ.51.35.D02.1.454.CMB.2.raw
  modified_base (330)..(330): a, c, t, g, unknown or other
  modified_base (480)..(480): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgtggtgatgtataaagcactgagaggccctgagggatccctgagcgattccnctggctccaggtcagggcaacggtcacattggccatcagtggagtccaggcagaggacgaggctgactattattgtacaatcaacagacaccattggtacttatgtctcggaactcgcgacacggtcacgtctggtcagccagccacccntcgcactcg

SEQ ID NO: 416722 - DNA, 592 bp, Homo sapiens
  misc_feature: GZ8MTXP02JQKMZ.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgatatgcttattggtaccagcagaacgccgggccaggcccctgtgttggtgatgtataaagacactgagacggcccctgagggtactcccgtgagcgtattccctcgtggctccgaggtcagggacaacggtcacagttggccatcgagtggagtccgaggcagaggacgaggctagactattacttgtacaatcaaacacgaacacctagttcggtaacttagtcgttacgttacgggaaacttcggaccgaaccgtaacggtccctaacccggttccgtacggggttaccaccggaaccccgaaaacggacccccaaaaccccgtacgtaccggtacccgtacctttccccg

SEQ ID NO: 416723 - DNA, 582 bp, Homo sapiens
  misc_feature: GZ8MTXP02HDAB6.51.35.D02.1.454.CMB.2.raw
  modified_base (238)..(238): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagagccgggcacggccctgtgtggtgatgtataaagacactgagacggccctcgagggctcccgtgagcgtattccctcgtcggctccgaggtcgagggacgaacggtcaacgtagttcggacctagtcgagtggacgtaccgagggcaagggacggacgagggctagacttattagttgtacaatcaacagaaccacgtagttcggttacttagtcgttacgtcgaaacttcggaccgaccgtaacgggtccaacccggttcgtacggggtaccaacggaaccccgaacggaccccaaaaccctacgtcgtaccacctttcccg

SEQ ID NO: 416724 - DNA, 579 bp, Homo sapiens
  misc_feature: GZ8MTXP02IUG4W.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgtggtgatgtataaagcactgagacggccctcgagggtactccccgtagagcgtatttccctcgtggtcctccgaggttccgaggggacgaacggtcactagttcggaccagtcaggtggacgtccgaaggcgagaggaccgaggctagactatttattgtacaatcaaacagaaccacctagttaggtaacttagttcgttacttacggaacttcggaccgaccgtaaacggtccaccgtcgtacgggtaccacggaacccgaacggaccccaaaccccgtgtacgtaccgtacttcccg

SEQ ID NO: 416725 - DNA, 533 bp, Homo sapiens
  misc_feature: GZ8MTXP02GFL11.51.35.D02.1.454.CMB.2.raw
  modified_base (238)..(238): a, c, t, g, unknown or other
  modified_base (283)..(283): a, c, t, g, unknown or other
  modified_base (415)..(415): a, c, t, g, unknown or other
  modified_base (422)..(422): a, c, t, g, unknown or other
  modified_base (442)..(442): a, c, t, g, unknown or other
  modified_base (516)..(516): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgtggtnatgtataaagacactgagacggccctcagggatccctgagcgattcctcgtgctccgaggtcgagggacaacggtcaacattcggaccatcaagtggagtccgagcaagaggacgagctgactattatgtanaatcaanagacacctattggtacttangtacgtacgaactcgacgaaccgaaacgtccgaaccgtccgtacggccacgaacccaacggacccaaacccctntacgtacacgtttcccg

SEQ ID NO: 416726 - DNA, 494 bp, Homo sapiens
  misc_feature: GZ8MTXP02IRFFM.51.35.D02.1.454.CMB.2.raw
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctcaggggatccccgtgagcgattcctctggctccaggtcagggacaacggtcacattggcatcagtgagtcaggcagaggacgaggctgactattattgtacaatcaacagacaccattggtacttatgtctggaactgcgacacggtcacgtctaggtcagccaaggccaacccatcgtcactc

SEQ ID NO: 416727 - DNA, 507 bp, Homo sapiens
  misc_feature: GZ8MTXP02J25W3.51.35.D02.1.454.CMB.2.raw
  modified_base (238)..(238): a, c, t, g, unknown or other
  modified_base (420)..(420): a, c, t, g, unknown or other
  modified_base (498)..(498): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtataaagacactgagaggccctgagggatccctgagcgattcctctggctcaggtcagggcaacggtcacattggccatcagtggatccgaggcaggaggacgaaggctagacttattattgtacaatcaanagacaccattggacttatgtactacggaactcgacgacaacggtcaccgtcgcggtcacgccgaacggccaacccacncgtcactcc

SEQ ID NO: 416728 - DNA, 570 bp, Homo sapiens
  misc_feature: GZ8MTXP02I1846.51.35.D02.1.454.CMB.2.raw
  modified_base (459)..(459): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggcaggcccctgtgtggtgatgtataaagacactgagacggcccctgagggactccccgtgacgcgtattccctcgtggctccgaggtccaaggggaccaaacgggtcaacattcggccatcgagtggagtccgaggcaagaggacgaggctagactattatgtacaatcaacagacactattaggtaacttangttacttacggaattcggacgtaaccgaacgggtaccacccggttccgtacggggtaccaccggaacccgaaacgggaccccaaaccccgtacgtcgtaccaactttcccg

SEQ ID NO: 416729 - DNA, 528 bp, Homo sapiens
  misc_feature: GZ8MTXP02H5W6N.51.35.D02.1.454.CMB.2.raw
  modified_base (238)..(238): a, c, t, g, unknown or other
  modified_base (332)..(332): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttattggtaccagcagaagccggccaggcccctgtgttggtgatgtataaagcactgagaggccctgagggatccctgacgcgattccnctggctccgaggtcgagggcaaacgggttcactattcggccatcagtggagtcccgaggcagaaggacggaggctagactattattgtacaattcaaacagacacctattggtacttatgtctacggaactgacgacctaaaggtccaccgtcctcgggtcacgaacccgacggacccacccgatcgtcacttccg

SEQ ID NO: 416730 - DNA, 506 bp, Homo sapiens
  misc_feature: GZ8MTXP02HGL9E.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgtggtgatgtataaagacactgagaggccctgagggatccctgagcgattcctctggctcaggtcagggcaacggtcacattggccatcagtggagtccgaggcagaggacgaggctgactattatgtacaatcaacagacacctattgtacttatgtcttacggaactgacgacaacggtcaccgtcgtcgggtcacgccgaacggcccacccgactcgtacactccg

SEQ ID NO: 416731 - DNA, 495 bp, Homo sapiens
  misc_feature: GZ8MTXP02HP0US.51.35.D02.1.454.CMB.2.raw
  modified_base (237)..(237): a, c, t, g, unknown or other
  modified_base (310)..(310): a, c, t, g, unknown or other
  modified_base (331)..(331): a, c, t, g, unknown or other
  modified_base (410)..(410): a, c, t, g, unknown or other
  modified_base (436)..(436): a, c, t, g, unknown or other
  modified_base (462)..(462): a, c, t, g, unknown or other
  modified_base (467)..(467): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggccaggcccctgtgttggtgatgtataaagacactgagaggccctnagggatccctgagcgattccnctggctccgaggtccagggcaacggtcacattggccatcagtggagtccaggcagaggacgaggctgactattattgtnaatcaacagacaccattggtacttangtctgaactgcgacaaggtcacgtcnggtcngaacccgagcccaacccatcgtacactc

SEQ ID NO: 416732 - DNA, 507 bp, Homo sapiens
  misc_feature: GZ8MTXP02IHMOC.51.35.D02.1.454.CMB.2.raw
  modified_base (222)..(222): a, c, t, g, unknown or other
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgntatgcttatggtaccagcagaagccgggccaggcccctgtgttggtgatgtataaagacactgagaggccctgagggatccctgagcgattcctctggctcaggtcagggcaacggtcacattgccatcagtgagtccagcagaggacgaggctgactattagttgtacaatcaacagacacattaggtacttatgtcttagaactgacgacaacgtccaccgtcgtcgggtacacgcccgaacggcccaaaccccatcgcctactccg

SEQ ID NO: 416733 - DNA, 588 bp, Homo sapiens
  misc_feature: GZ8MTXP02IAO5L.51.35.D02.1.454.CMB.2.raw
  modified_base (226)..(226): a, c, t, g, unknown or other
  modified_base (296)..(296): a, c, t, g, unknown or other
  modified_base (427)..(427): a, c, t, g, unknown or other
tcagcgatcgtatacacgaccggtgctcgatttagcacacgatagttggggtttgggggtgggtccaggaggcagaactctgggtgtctcaccatggcctggatccctctacttcctccccctcctcactctctgcacaggctctgaggcctcctatgagctgacacagcccaccctcggtgtcagtcgtcccaggacaggacggccaggatcacctgctctgganatgcattcgaccaaacgatatgtctttattggtaccagcaggaacgccgggccacggcccctgtgttggngatgtaataaagacacgtaggaggacggccctgaggggtactccccgtagagcgtattcctcgtggcctcgaggtcgaaggggacaacgggtcactagttcgccatcgagtggactcgaggcagaggacgnggactgacttatattgacaatcaaatacgacaactattaggtaacttagttgttccgtttacggaaacttcggaccgtacgtaaacggtcccgtaaccggtccgttacggggtacaccggaacccgaacggaccccaacccgactcggtacctacttcccg

SEQ ID NO: 416734 - DNA, 598 bp, Homo sapiens
  misc_feature: GZ8MTXP02JPCY8.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttcttcccctcctcactctctgcacaggctctgaggcctcctatgagctgacacagccaccctcggtgtcagtgtccccaggacagacggccaggatcacctgctctggagatgcattgccaaacgntatgcttatggtaccagcagagccggccaggcccctgtgtggtgatgtataaagacactgagacggccctgacgggactcccgtgagcgtattccctctggctccgaggtcgaacggggcaacgggtcactagttcggcatcagtggacgtcccgaggcaaggaggacgaggtctgacttattagttgtacaattacaaacgtagaacctaccaagtttacggtacttaagttcggttacttacggtaaacttcggaccgtaaaccgaaacgggttcccaaccggttccgttacgggtaccgaaccggaaccccgaaacggaccccgaaccccacgtaccggtaccctaacgtttccccg

SEQ ID NO: 416735 - DNA, 501 bp, Homo sapiens
  misc_feature: GZ8MTXP02H68RW.51.35.D02.1.454.CMB.2.raw
  modified_base (311)..(311): a, c, t, g, unknown or other
  modified_base (412)..(412): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgtggtgatgtataaagacactgagaggccctnagggatccctgagcgattcctctggctccaggtcagggcaacggtcacattggccatcagtgatcagcagaggcgagctgactataattgtacaatcaaanagacaccattggtacttatgtcttggaactgcgtaccaaaggtcaccgtcctgggtcagaacccaacggcccaaacccactcgtcactc

SEQ ID NO: 416736 - DNA, 512 bp, Homo sapiens
  misc_feature: GZ8MTXP02JAXJZ.51.35.D02.1.454.CMB.2.raw
  modified_base (238)..(238): a, c, t, g, unknown or other
  modified_base (311)..(311): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgtggtgatgtataaagacactgagaggccctnagggatccctgagcgattcctctggctccaggtcagggcaacggtcacattggccatcagtggagtccaggcagagcgaggctgactattatgtacatcaacagacaccattggtacttatgtcttacggaacttggacgaccaaagggtccaaccgtccgtgggtccacgcccaaggcccaaacccactcgtcacttccg

SEQ ID NO: 416737 - DNA, 544 bp, Homo sapiens
  misc_feature: GZ8MTXP02GLYL8.51.35.D02.1.454.CMB.2.raw
  modified_base (239)..(239): a, c, t, g, unknown or other
  modified_base (312)..(312): a, c, t, g, unknown or other
  modified_base (538)..(538): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttatggtaccagcagaagccgggccaggcccctgtgttggtgatgtataaagacactgagaggccctnagggactccctgagcgtattcctctggctccgaggtcagggaccaacgggtcaacagttggaccatacagtggagtcccgaggcaaggaggacggaggcgtgactattaagttgtactaaatcaaacagaaccaacctatttcggtaacttatcgttacttacggaactggacgtacaaacgggtcaccgtccgtcgggtcacgccaacggccaacccgatcgacncttccg

SEQ ID NO: 416738 - DNA, 509 bp, Homo sapiens
  misc_feature: GZ8MTXP02HEZPF.51.35.D02.1.454.CMB.2.raw
  modified_base (239)..(239): a, c, t, g, unknown or other
  modified_base (282)..(282): a, c, t, g, unknown or other
  modified_base (417)..(417): a, c, t, g, unknown or other
  modified_base (420)..(420): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggccaggccctgtgtggngatgtataaagacactgagacggccctgagggatccccgtagagcgtattcctctggctccgaggtcgagggacaaacggtcacattgccatcagtgagtccaggcagaggacgaggctgactattatgacatanaanagacaacattaggtacttagtgtacttcggaaactgacgaccaaacggcacgtcgcggtacacgccaagacccacccatcgaccactcc

SEQ ID NO: 416739 - DNA, 502 bp, Homo sapiens
  misc_feature: GZ8MTXP02HBMHT.51.35.D02.1.454.CMB.2.raw
  modified_base (238)..(238): a, c, t, g, unknown or other
  modified_base (438)..(438): a, c, t, g, unknown or other
  modified_base (488)..(488): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgtggtgatgtataaagacactgagaggcccctcgagggactcccctgacgcgtattccctctggctccaggtcaggggcaacgggtcacattggccatcagtgagtcaggcagagacgagctgactattatgtacatcacagacaccattggtactatgtnttcgaactgcgacaaggtcaccgtctcggtcacgccacggccctaacccngtcgtacacttccg

SEQ ID NO: 416740 - DNA, 497 bp, Homo sapiens
  misc_feature: GZ8MTXP02HW2DL.51.35.D02.1.454.CMB.2.raw
  modified_base (278)..(278): a, c, t, g, unknown or other
  modified_base (433)..(433): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagagccggcagccctgtgtggnatgtataaagacactgagacggccctgagggactccctgagcgtattcctctggctcgaaggtcagggcaacggtcacagttcgccatcagtgagtccgagcagaggacgaggctagactattattgtacaatcaacagacacatgtactatgtntcgaactgacacgaagtcaccgtctgggtcacgaacccgaggcccaaccccactcgtcactccg

SEQ ID NO: 416741 - DNA, 498 bp, Homo sapiens
  misc_feature: GZ8MTXP02HV9YC.51.35.D02.1.454.CMB.2.raw
  modified_base (309)..(309): a, c, t, g, unknown or other
  modified_base (463)..(463): a, c, t, g, unknown or other
  modified_base (487)..(487): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggcaggccctgtgttggtgatgtataaagacactgagaggccctnagggatccctgagcgattcctctggctccgaggtcagggcaacggtcacattgcatcagtgagtccagcagaggacgaggctgactattattgtacaatcaacagacaccattagtacttatgtcttcggaactgcgaccaaaggtcaccgtcncgggtcagcccaaggcccaacccntacgtcactcg

SEQ ID NO: 416742 - DNA, 513 bp, Homo sapiens
  misc_feature: GZ8MTXP02HRJ8S.51.35.D02.1.454.CMB.2.raw
  modified_base (222)..(222): a, c, t, g, unknown or other
  modified_base (309)..(309): a, c, t, g, unknown or other
  modified_base (329)..(329): a, c, t, g, unknown or other
  modified_base (414)..(414): a, c, t, g, unknown or other
  modified_base (433)..(433): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaacgatatgcttatggtaccagcagaagccgggccaggccctgtgtggtgatgtataaagacactgagaggccctnagggatccctgagcgattcnctgctccaggtcagggacaacggtcacattggcatcagtgagtccaggcagaggacgaggctgactattattgtacaaatcaaanagacaccattggtacttangttctacgaactgacgaacaaggtcaaccgtcgtcgggtcacggaacccaaggaccccaacccgactacgtccacttccg

SEQ ID NO: 416743 - DNA, 576 bp, Homo sapiens
  misc_feature: GZ8MTXP02JZPL4.51.35.D02.1.454.CMB.2.raw
  modified_base (238)..(238): a, c, t, g, unknown or other
tcagcgatcgtatacacgaccggtgctcgatttagcacacgatagttgagtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggccaggcccctgtgttggtgatgtataaagacactgagacggccctcgagggactcccgtgagcgtacttctcgtggcctcgaggtcaggggaccaacgggtcactagttcggaccatcgaggtggacgtccgaggcaggaggacgagggctgaacttattattgtacaatcaaacagaccaccgtagttcggtacttagtcgttcgttacggaacttcggaccgaaccgaaaggtccaacccgttcccgtaggggtaccaacggacccccgaaacggacccccaaaccccgtacgttacggtacctacccg

SEQ ID NO: 416744 - DNA, 587 bp, Homo sapiens
  misc_feature: GZ8MTXP02ITTJJ.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggccacggccctgtgtggtgatgtaataaagacactagagacggccctacgagggactcccgtagagcgtattcccgtcgtggctccgaggtcgaagggaccaacgggtcactagttcggaccatcagtgacgtccgaggcagaggacgagctagactattatgtacaatcaacagacactagttaggtacttagtacgttacgttacggaaactcggacgtaacccgaacggtaccctaacccggttccgtacggggtaccaaccggaaccccgaaaccggaccccctaaaacccccgactacggtacccaacctttccccg

SEQ ID NO: 416745 - DNA, 749 bp, Homo sapiens
  misc_feature: GZ8MTXP02ITQUZ.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcacggccctgtgtggtgatgtataaagacatagagacggccctgagggactcccgtagacgcgtattccctcgtcggcctaccgaggtacgaggggaccgaaacgggtcaacgtagttcgggacctagttacgacggtagggacgttacccgaaggggcccgaaaggggtaacggggaacccggaagggggtacccgttaagggtaaaccgtttaaatttttaaagtttacgggttaaccctaaaaagtttacccaaaaaccgtacgggaaaacccctaaccccgttaaaggttttaacgggtttaacctttaaagttcggtttaccgtttaccggggaaaacttcgggaacccggtaaaccgtaaacgggttacccgtaaaccccgggtttcccggttacggggttacccaacggtaacccccgaaaacgggtacccccaaaacccccgtaacgttcccggttaccctaaccctttccccgg

SEQ ID NO: 416746 - DNA, 534 bp, Homo sapiens
  misc_feature: GZ8MTXP02HPC47.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggccacggcccctgtgttggtgatgtataaagacactgagacggccctgagggactcccgtgagcgattccctcgtggctccgaggtcgaagggacaacggtcactagttcggccatcgagtgagtccgaggcagaggacgaggctagacttattattgtacaatacaacagaccactattgtacttagtgtctacgaactcgaccgacacgtcctaaccgtcgtacgggtcaacgcccgaacgacccaacccactcgtacctactcccg

SEQ ID NO: 416747 - DNA, 488 bp, Homo sapiens
  misc_feature: GZ8MTXP02GVYBJ.51.35.D02.1.454.CMB.2.raw
  modified_base (314)..(314): a, c, t, g, unknown or other
  modified_base (411)..(411): a, c, t, g, unknown or other
  modified_base (457)..(457): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctnagggatccctgagcgattcctctggctccaggtcagggacaacggtcacattgccatcagtgatcaggcagaggacaggctgactattatgtcaatnaacagacacattgtacttatgtctgaactgcaccaaggtcacgtcncggtcagcccgaagcccaaccatcgcactcc

SEQ ID NO: 416748 - DNA, 496 bp, Homo sapiens
  misc_feature: GZ8MTXP02H41S3.51.35.D02.1.454.CMB.2.raw
  modified_base (281)..(281): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggcaggccctgtgtgngatgtataaagacactgagaggccctgagggatccctgagcgtattcctcgtggctccgaggtcagggcaacggtcacattgccatcagtgagtccaggcagaggacgaggctgactattattgtacaaatcaacagacaccattgtacttatgtctcgaactgcgacaagtcaccgtctggtcagcccgaagcccaaacccatcgtcacttccg

SEQ ID NO: 416749 - DNA, 563 bp, Homo sapiens
  misc_feature: GZ8MTXP02F48DV.51.35.D02.1.454.CMB.2.raw
  modified_base (310)..(310): a, c, t, g, unknown or other
  modified_base (418)..(418): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccggcaggccctgtgtggtgatgtataaagacactgagaggccctnagggatccctgagcgattcctctggctccgaggtcagggacaacggtcactattggaccatcagtggatcgaggcagagacgaggctgactattatgtacaatcaaanagaacacctattaggtactttaatgttcttacgggaactgaccgaaccgtaaacgggtccaaccggtccgtacggggtaccaacggaaccccgaaaacgggaccccctaaaaacccccgtacgttaccggtacctaccgttaccg

SEQ ID NO: 416750 - DNA, 631 bp, Homo sapiens
  misc_feature: GZ8MTXP02GGI6X.51.35.D02.1.454.CMB.2.raw
  modified_base (238)..(238): a, c, t, g, unknown or other
  modified_base (282)..(282): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgttggngatgtaataaagacactgagaggccctgagggctccctgagcgtattccctcgtcgctaccgaggtcgaaggggaccaaccgggtcaacgtagttcggacctagtcaagggtggaacgtcccgaggaccaagggacgggaccggaggtcctaggaacttagttagttcgtacaacttacaaacaagaaccaaccttaagttacggttaactttagtacgtttaccgttaacggtaacgttacgacccggtaaacgtaacggttaccaacccggttccgttacggggtaccaaccggccccgaaaaccggacccccaaaaccccgtcgtaccggtcccaaccgtttcccg

SEQ ID NO: 416751 - DNA, 585 bp, Homo sapiens
  misc_feature: GZ8MTXP02G8I75.51.35.D02.1.454.CMB.2.raw
  modified_base (240)..(240): a, c, t, g, unknown or other
  modified_base (284)..(284): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccgggcaggcccctgtgtggngatgtataaagacactgagaggccctgagggatcccgtgagcgtattcccgtctggctccgaggtcgagggaccaaacgggtcacgagttgggccatcagtggagtccgaggctaaggaggacgaggtctaggactagtttattgtacaagttcaaactagaactaccagttacggtacttatgttacttacggaaacttcggaccgtaccgaaacggtccaacccggttccgtacggggtaccaccggaacccgtaaacggtacccaaaaccccgtacgtccgtacctaaccgtttcccg

SEQ ID NO: 416752 - DNA, 488 bp, Homo sapiens
  misc_feature: GZ8MTXP02IORL4.51.35.D02.1.454.CMB.2.raw
  modified_base (237)..(237): a, c, t, g, unknown or other
  modified_base (450)..(450): a, c, t, g, unknown or other
  modified_base (458)..(458): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggacagcagaagccggcaggccctgtgtgtgatgtataaagacactgagaggcccctgagggatccctgagcgattcctctggctccaggtcagggcaaggtcacattggccatcagtgagtcaggcagagacgagctgactattatgtacaatcaacagacacgattggtactatgtacttcgaatgcgacaaggtcacgtcncgggtacncgaaccgaacggccaacccatcgtcacttc

SEQ ID NO: 416753 - DNA, 760 bp, Homo sapiens
  misc_feature: GZ8MTXP02IS7RE.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccggccaggcccctgtcgttggtgatgtataaagacactgagacggccctagagggactcccgtgacgacgtattcccgtctgggtcctaccgaggtccgaaggggaccaaaccgggttacaacgtacgttacgggaccctaaagtccgaaggttaggaacggttccccgaaagggaccaaaggggaaacggggaaccggtaaaggggcccttaagggtaaacccgtttaaattttaagtttacggtttaaaccaaaacgtttaccgaaaaaacctaacgggaaaaccctaaacccgttaagttttacggggttaaacccttttaaagttcggttaccgtttacggggaaaaccctttgggaacccggtaaaaccccgtaaagggttacccgtaaaccccggttccggttaacggggttccaaaccggtaacccccgaaaacggggtaaccccctaaaaccccccgaacgttccggtaaccctaaccctttccccgg

SEQ ID NO: 416754 - DNA, 509 bp, Homo sapiens
  misc_feature: GZ8MTXP02H9XF6.51.35.D02.1.454.CMB.2.raw
  modified_base (222)..(222): a, c, t, g, unknown or other
  modified_base (398)..(398): a, c, t, g, unknown or other
  modified_base (420)..(420): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgcattgaccaaacgatatgcttatggtacagcagaagccggcaggcccctgtgtggtgatgtataagacactagagaggccctgagggatccctgagcgattcctctggctcgaggtcgagggacaacgggtcactattggccatcagtggagtccgaggcaggaggacgaggntgactattattgtacaatcaanagacacatggtactatgtctgactgacgacacgtcaccgtcgtcggtcacgaacccgaacggcccaaccctactccgtactacctcccg

SEQ ID NO: 416755 - DNA, 596 bp, Homo sapiens
  misc_feature: GZ8MTXP02GR4GU.51.35.D02.1.454.CMB.2.raw
  modified_base (240)..(240): a, c, t, g, unknown or other
  modified_base (285)..(285): a, c, t, g, unknown or other
  modified_base (324)..(324): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatggtaccagcagaagccgggccaggcccctgtgtggngatgtataaagcactgagaggccctgagggatccctgancgtattcctctggctcgaggtcagggcaacggtcactagttggccatcagtggacgtccgaggcaggaggacgaggctgactattatgtacatcaacagacactaagttggtacttagtcgttacgttacggtaaacttcggaccgtaaccgtaaacgggttacccgaacccgttaccggtttcgggggtaccctaaccggtaacccccggaaaccggggacccccaaaacccccggtaacgttccggttacccgtaaaccctttcccccgg

SEQ ID NO: 416756 - DNA, 501 bp, Homo sapiens
  misc_feature: GZ8MTXP02H4VS9.51.35.D02.1.454.CMB.2.raw
  modified_base (406)..(406): a, c, t, g, unknown or other
  modified_base (413)..(413): a, c, t, g, unknown or other
  modified_base (490)..(490): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttatggtaccagcagaagccgggccaggcccctgtgttggtgatgtataaagacactgagaggccctgagggatccctgagcgattcctctgctcgaggtcaggggacaacggtcacattggcatcagtgagtcaggcagagacgagctgactattatgtanaatcaanagaacaccattggtacttatgttctcggaactgcgaccaaggtcaccgtccgtggtccacgcccaaggcccaacccnctcgtcactcc

SEQ ID NO: 416757 - DNA, 573 bp, Homo sapiens
  misc_feature: GZ8MTXP02HMYMN.51.35.D02.1.454.CMB.2.raw
  modified_base (239)..(239): a, c, t, g, unknown or other
  modified_base (306)..(306): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcccaaacgntatgcttatggtaccagcagaagccgggccaggcccctgtgttggtgatgtaataaagacactgagnggccctgagggatcccgtgacgcgattccctctggctcgaggtcgaagggcaacgggtcacagttggccatcagtggagtccgaggcaggaggacgaggctgactagttattgtacaaatcaaacacgaacacctagttaggtactttagtcgttacgtttacggaacttcggacgaaccgtaacggtaccaacccggttccgtacggggttcccaacggaaccccgaacggaccccaaacccccgtatccgtacctacgtttcccg

SEQ ID NO: 416758 - DNA, 518 bp, Homo sapiens
  misc_feature: GZ8MTXP02G9W84.51.35.D02.1.454.CMB.2.raw
  modified_base (223)..(223): a, c, t, g, unknown or other
  modified_base (240)..(240): a, c, t, g, unknown or other
  modified_base (434)..(434): a, c, t, g, unknown or other
  modified_base (505)..(505): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattgaccaaacgntatgcttattggtaccagcagaagccgggcacggcccctgtgtggtgatgtaataaagacacgtgagacggccctgagggactcccgtagacgcgattcctcgtggctccgaggtcgaagggacaacgggtcacagttcggaccatcgagtgagtccgaggcaaggagacgagcagactattatgtacatcaanagacactatgtacttatgtactcgaactgacgactacgtcacgtcgcggtcacgaaccgacgacccaaccntcgtacacttccc

SEQ ID NO: 416759 - DNA, 542 bp, Homo sapiens
  misc_feature: GZ8MTXP02GIY5D.51.35.D02.1.454.CMB.2.raw
  modified_base (268)..(268): a, c, t, g, unknown or other
  modified_base (504)..(504): a, c, t, g, unknown or other
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtgggggggcgtggtccaggcgtgggaggtccctgagactctcctgtgcagcctntggattcaccttcagtacccatgaaatgcactgggtcccgccaggcctccgaggcgaaggggctgggaggtggggtggctagttatatcctatgatggaagcaaataagcactacgcagagtccgtagaaggccagtgaccatctccagagacaactacgaaagaaatacggtttcttactaacaaatacgaaactagcctagacgagctaggaggacacggtctagttgtttacnggtgacgaaggaggaactacggattacacgtacgaacg

SEQ ID NO: 416760 - DNA, 562 bp, Homo sapiens
  misc_feature: GZ8MTXP02I1EVG.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgaggggatccccgtgagcgattcctctggctccgaggtccaggggtaccaaacgggtcactattcgggaccattcgagtggagtccaaggcagaggacgaggctagactattattgtacaatcaaacagaaccaccatttaggtacttaatgtcttacggaactcggtacgaccgtaaggtccaaccgttccgtagggtccacgaaccccgaacggaccccaaaaccccgctcggtacctaacttcccg

SEQ ID NO: 416761 - DNA, 568 bp, Homo sapiens
  misc_feature: GZ8MTXP02JMTNI.51.35.D02.1.454.CMB.2.raw
  modified_base (222)..(222): a, c, t, g, unknown or other
  modified_base (545)..(545): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccgggccaggcccctgtgttggtgatgtataaagacactgagacggccctgagggactccctgagcgtattcctctgctccgaggtcgagggacaacgggtcactagttggaccatcgagtggagtcgaggcagaggacgagctgactattattgtacaagtcaacagaaccacctaagttcggtaacttatcgttacgttacggaatcggaccgaaccgtaaacggtccacccggttcgtacggggtcccaacggcccgaaacgggaccccaaacccccngtaccgtaccgaaccgtttcccg

SEQ ID NO: 416762 - DNA, 528 bp, Homo sapiens
  misc_feature: GZ8MTXP02J4PC4.51.35.D02.1.454.CMB.2.raw
  modified_base (379)..(379): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtgtccccaggacagacgccaggatcacctgctctggagatgcattgccaaaccgatatgctttatggtaccagcagaagccgggccaggcccctgtgttggtgatgtataaaagacactgagaggccctcagggatcccctgagcgattcctctggctccaggtcaggcgaacgtacgcatagtcgactatacgngtaggacgcggagacgaggacgagaaggtcgagtactattattactatactacaacacacacacgtgtaactatacgtgtacgtcgtacgtacgacgtacgacgtaccgacgtcgtacgtccgcgaccgacaccgcaaccgacctaccg

SEQ ID NO: 416763 - DNA, 537 bp, Homo sapiens
  misc_feature: GZ8MTXP02FNS4D.51.35.D02.1.454.CMB.2.raw
  modified_base (430)..(430): a, c, t, g, unknown or other
  modified_base (523)..(523): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctcgagggactcccgtgagcgtattcctctggctccgaggtcgagggcaacggtcacattggccatcagtggagtccgaggcagaggacgaggctagacgtattagtgtacaatcaanagacaccattgtacttatgtacttacggaactcgacgaaccgaaacggtccacccggtcgtacgggtcacgcccgaaacggccccaaaccccngtacgtccacttcc

SEQ ID NO: 416764 - DNA, 710 bp, Homo sapiens
  misc_feature: GZ8MTXP02JGZYJ.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggcacggcccctgtgtggtgatgtataaagacatgagacggccctcgagggactcccgtgacgcgtattcccgtcgtcggcctaccgaggttcgaacggggaccgaaccgggttacaacgtaacgttcgggaccctaagttccgaaggtcggaacggtacccgaagggccgaaagggaagggacggtaacgggcgttacggaaaccttaagtttaaagtttacgttacctaaaattacgaaaaccaaacggaacccaacccgtaatttacgggttaacctttaagttcggtttaccgtttacggaaaacgttcggaccgtaaacccgtaaacgggtacctaacccggttacccggtacggggttacccaaaccggaacccccgaaaacccggggaacccccaaaacccccctaacggttacccttaacccgtaaccctttccccgg

SEQ ID NO: 416765 - DNA, 516 bp, Homo sapiens
  misc_feature: GZ8MTXP02I1UFO.51.35.D02.1.454.CMB.2.raw
  modified_base (313)..(313): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctnagggatccctgagcgattcctctggctccgaggtcagggacaacggtcacattggccatcagtggatccaggcagaggacgaggctgactattattgtacaatcaaacagacaccattggtacttatgtctacggaactcgacgaccaaggtcaaccgtctcgggtacacgaacccgaaggcccaacccgatcgtacacttcc

SEQ ID NO: 416766 - DNA, 562 bp, Homo sapiens
  misc_feature: GZ8MTXP02JOTQT.51.35.D02.1.454.CMB.2.raw
  modified_base (426)..(426): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccgggccaggcccctgtgttggtgatgtataaagacactgagacggccctcgagggactcccgtgagcgattcctcgtggctccgaggtcagggacacggtcacattcggcatcagtggacgtccgaggcagaggacgagctgactattattgtacaagtcaanacgaacaacctagtttacggtactttagtgttacgtttacggaacttcggaccgaaccgtaacggtaccctacccggtccgtcggggtaccacggaacccgaacggacccccaaacccactcgtaccactttcccg

SEQ ID NO: 416767 - DNA, 526 bp, Homo sapiens
  misc_feature: GZ8MTXP02I7DCB.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagacggcccctacgaggggatccccgtgagcgattcctctggctccgaggtcagggacaacggtcacgattggccatcagtggagtccgaggcaggagcgaggctgactattagtgtacaatcaacagacacgaatttggtaacttatgtcgtacggactcgacgacgaacggtcaccgtccgtcggtcacgcccgaaaggccctaacccacgtcgtacactcc

SEQ ID NO: 416768 - DNA, 588 bp, Homo sapiens
  misc_feature: GZ8MTXP02HRUPW.51.35.D02.1.454.CMB.2.raw
  modified_base (222)..(222): a, c, t, g, unknown or other
  modified_base (328)..(328): a, c, t, g, unknown or other
  modified_base (440)..(440): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaagccgggccaggcccctgtgttggtgatgtaataaagacactgagacggccctgagggactcccgngagcgtattcctcgtcgctccgaggtcgagggaccaacggtcacgtacgttcggacctagtcaggtgacgtcgaggcgagaggacgaggctgactattagtgtacaatcaanacgacaacgtagttacggtacttagtagttacgttacggaacttcgaccgtaaccgaacggtaccaccggttccgtacgggtaccgaaccgtaacccgaaacccgggaccctaaacccccacgttaccggtaccctaacctttccccg

SEQ ID NO: 416769 - DNA, 514 bp, Homo sapiens
  misc_feature: GZ8MTXP02H0VCF.51.35.D02.1.454.CMB.2.raw
  modified_base (237)..(237): a, c, t, g, unknown or other
  modified_base (431)..(431): a, c, t, g, unknown or other
  modified_base (448)..(448): a, c, t, g, unknown or other
  modified_base (480)..(480): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacgccaggatcacctgctctggagatgcattgccaaacgntatgctttatggtaccagcagaagccgggccaggcccctgtgttggtgatgtataaagacactgagaggcccctagagggtatcccgtgagcgtattccctcgtggctccgaggtcagggcaacgggtcaactgttcgccatccagtggacgtccgaggcagaggacgaggctgactattattgtacaatcaanagacactattgtacttngtctacgaactcgacgacaagtccaccgtcgnggtacacgcccgaagcccaccactcgctacgtcc

SEQ ID NO: 416770 - DNA, 573 bp, Homo sapiens
  misc_feature: GZ8MTXP02JT8C6.51.35.D02.1.454.CMB.2.raw
  modified_base (178)..(178): a, c, t, g, unknown or other
  modified_base (428)..(428): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggngtcagtgtccccaggacagacggccaggatcacctgctctggagatgcattgccaaaccgatatgcttattggtaccagcagaagccggccaggcccctgtgttggtgatgtataaagacactgagacggccctcgagggactcccgtagacgcgtattcctctggctccgaggtcgagggccaacgggtcacattggccatcagtggagtccaggcagaggcgaggctgactattatgtacaatcaacngaacaccgtattacggtacttagtagttccgttacgggaaactcgaccgaaccaaacggttcgacccggttaccgtcggggttaccaccggaaccccgaaacgggaccccaaaacccccgtacgtcggttacccaacgtttcccg

SEQ ID NO: 416771 - DNA, 537 bp, Homo sapiens
  misc_feature: GZ8MTXP02FPKN2.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcaggcccctgtgttggtgatgtataaagacactgagaggcccctacgagggactccctgagcgtattcctctgctccaggtcagggcaacggtcacattcgcatcagtgagtccgagcagaggacgaggctgactagttattgtacaatcaacagaacacccattacggtactttaatgtctttacggaacttggacgaaccgaacggttccaaccgttccgtagggtcacgcccgaacggccctaaaccccactacgacctacttccg

SEQ ID NO: 416772 - DNA, 620 bp, Homo sapiens
  misc_feature: GZ8MTXP02H22K9.51.35.D02.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacgccaggatcacctgctctgganatgcattgaccaaacgntatgcttattggtaccagcagaagccgggcaggcccctgtgtggtgatgtataaagacactgagacggccctgagggactcccgtagagcgattcctctggctccgaggtcgagggacgaacggtcactagttcgccatcgagtggagtccgaggcgagaggacggaggactagacttaagttattacgtacaacttacaaacaggacctaaccgtagtttaggttaacttagttcgttaccgtttacggaacgttcggaaccggtaacccgtaaacgggttccctaaccggttcccgtacggggttaccaaccggaaccccgtaaaacgggaaccccctaaacccccgtacgttacccggtaccttaacccgtttccccg

SEQ ID NO: 416773 - DNA, 600 bp, Homo sapiens
  misc_feature: GZ8MTXP02G3NZD.51.35.D02.1.454.CMB.2.raw
  modified_base (239)..(239): a, c, t, g, unknown or other
  modified_base (242)..(242): a, c, t, g, unknown or other
  modified_base (256)..(256): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntangcttattggtaccngcagaagccggccagcccctgtgtggtgatgtaataaagacactgagtacggccctgagggactcccgtgagcgtattcctcgtggctccgaggtcgaggggacaacgggtcacgtagttcggaccatcaagtggacgtccgaggcaagaggacgaggctagacgtattaagtgtacaattacaaacagactaaccgtagttacggtaactttagtcgtacctttacgggaaacttcggaccgtaacctaaacggtccgtaacccggttccgtacggggtaccaacggaaccccgaaacggacccccaaaacccccgtactccggtacctaccgtttcccccgg

SEQ ID NO: 416774 - DNA, 607 bp, Homo sapiens
  misc_feature: GZ8MTXP02HH4LC.51.35.D02.1.454.CMB.2.raw
  modified_base (239)..(239): a, c, t, g, unknown or other
  modified_base (278)..(278): a, c, t, g, unknown or other
  modified_base (284)..(284): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccgggcaggcccctgngttggngatgtataaagcactgagacggccctcgagggatcccgtgagcgattccctcgtgcctccaggtcgaagggaccaacgggtcaacgtagttcggccctaagtccgaggttcggaggttcccgaagggccaagggtagggaccggaaggtccgtaggacttaagtttacttaggtacaattacaaacagaaccaccagtttaggtacttagtgttccgtttacggaaaccttgaccgtaacgtaaacggttccaaccgtccgtcgggtaccacgaaccccgaaggtaccccaaaaccccgacgtccgtaccaccctttccccgg

SEQ ID NO: 416775 - DNA, 578 bp, Homo sapiens
  misc_feature: GZ8MTXP02I2730.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatgtaccagcagaagccggcacggcccctgtgtggtgatgtataaagacactgagaggccctcgagggactccctgagcgtattcctctgctcgaggtcgagggacaacggtcactattggccatcagtggagtccgaggcagaggacgaggctgactattaattgacaatacaacagtaaccaacctagttacggttactttaagtcgttacgttacgggtaactcggaccgtaaccgtaaacgggtcctaacccggttccgtacgggggtaccaacggaaccccgaaacgggacccctaaaacccccacgtaccgtaccaacctttccccg

SEQ ID NO: 416776 - DNA, 550 bp, Homo sapiens
  misc_feature: GZ8MTXP02IKNDV.51.35.D02.1.454.CMB.2.raw
  modified_base (222)..(222): a, c, t, g, unknown or other
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgacccaaacgntatgcttattggtaccagcagaagccgggcacggccctgtgtggtgatgtaataaagcactgagacggcccctagagggactcccgtgacgcgtattccctcgtcgctaccgaggtcaacgggacaacggtcactagttcgcatcgagtgacgtcagcagaggacgagctagactattatgtacaatacaacagaccactagttacggttacttagtgttacgtacgaactcgacgtaaaccgaggttaccaccgtcgtacgggtcaaccgtaacccgaacggacccaaccctagtcgtactacttcccg

SEQ ID NO: 416777 - DNA, 507 bp, Homo sapiens
  misc_feature: GZ8MTXP02HUKDO.51.35.D02.1.454.CMB.2.raw
  modified_base (306)..(306): a, c, t, g, unknown or other
  modified_base (340)..(340): a, c, t, g, unknown or other
  modified_base (347)..(347): a, c, t, g, unknown or other
  modified_base (355)..(355): a, c, t, g, unknown or other
  modified_base (400)..(400): a, c, t, g, unknown or other
  modified_base (430)..(430): a, c, t, g, unknown or other
  modified_base (478)..(478): a, c, t, g, unknown or other
  modified_base (482)..(482): a, c, t, g, unknown or other
tcagcgatcgtatacacgaccggtgctcgatttagcacacgatagttgggtttggggagctctgggagacgagcccagcactggaagtcgccggtgtttccattcggtgatcatcactgaacacagaggactcaccatggagtttgggctgagctgggttttcctcgttgctcttttaagaggcgtccagtgtcaggtgcagctggtggagtcgtggggggggctggtccaggctgggaggtccctgagactctcctgtgcagcctctggattcaccttcagtacccatgaaatgcactgggtccncaggctcaggcaagggctggagtggtgcagttanatcctangatggaancaaataagcactacgcagagtcgtagaggcatgaccatctcaganacaactacgaaagaatacggttatactaanaaactagaacagcctagagagctaggacgacgaggctagtagtttacngtgngaagaggactacgatacagacaacg

SEQ ID NO: 416778 - DNA, 677 bp, Homo sapiens
  misc_feature: GZ8MTXP02H9H1Z.51.35.D02.1.454.CMB.2.raw
  modified_base (227)..(227): a, c, t, g, unknown or other
  modified_base (247)..(247): a, c, t, g, unknown or other
  modified_base (660)..(660): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcaggtcgtccccaggacaggacgccaggatcacctgctcgtggganatgctattcgacccaaacgntatgtactttatggtaccagcagaacgccgggaccacggcccctggtcgttgggtgtatagtaagtaaagacacgtaggagacggccctaggagggtactcccgtaggacgcggtacttcccgtcgtcgggtacctccgtacggtccgaacgggaccgaaaccggttacaacgtagttccgggaccctaagttccgaggtacgggacgtacccggagggaccgaaggggaacgggtacgggacggtcgtacgggtaacttagtttaacgtttgtaaccgtaaacttacaaaccgaggtaaccctaaccgtagtttacgggtaactttacgttacgttacgttacggaacttcgaccgtaccgaacgttcccgaccgttcgacggtcaccgaacccgacggacccctaacccgngtaccgctaccttcccg

SEQ ID NO: 416779 - DNA, 544 bp, Homo sapiens
  misc_feature: GZ8MTXP02GQAAB.51.35.D02.1.454.CMB.2.raw
  modified_base (238)..(238): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagagccgggccaggcccctgtgtggtgatgtaataaagacactgagacggccctcgagggactcccgtgagcgtattccgtctgctcgaggtcgagggacgaacggtcaacgtagttcggcctatcgagtggaacgtcccgaggcgaggaggacgaggctgacttagttattgtacaatcaacacgacaactagttacgtacttatgttacgtagtaactcgacgacgacgtccaccggtctcgggtaccacgaacccgaacggacccacccacgtcgctacttcccg

SEQ ID NO: 416780 - DNA, 484 bp, Homo sapiens
  misc_feature: GZ8MTXP02FGXUR.51.35.D02.1.454.CMB.2.raw
  modified_base (239)..(239): a, c, t, g, unknown or other
  modified_base (314)..(314): a, c, t, g, unknown or other
  modified_base (410)..(410): a, c, t, g, unknown or other
  modified_base (415)..(415): a, c, t, g, unknown or other
  modified_base (417)..(417): a, c, t, g, unknown or other
  modified_base (429)..(429): a, c, t, g, unknown or other
  modified_base (477)..(477): a, c, t, g, unknown or other
  modified_base (479)..(479): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggccccctgtgttggtgatgtataaagacactgagaggccctnagggatccctgagcgattcctctggctccaggtcaggggcaaacggtcacattggcatcagtgagtcaggcagagacgaggctgactatatgcatnacaananacatagtatatntctcgacacgacacaacgacacgtcgtcgcacgccgacgaccaccacncncactc

SEQ ID NO: 416781 - DNA, 515 bp, Homo sapiens
  misc_feature: GZ8MTXP02F7VCS.51.35.D02.1.454.CMB.2.raw
  modified_base (238)..(238): a, c, t, g, unknown or other
  modified_base (396)..(396): a, c, t, g, unknown or other
  modified_base (399)..(399): a, c, t, g, unknown or other
  modified_base (414)..(414): a, c, t, g, unknown or other
  modified_base (501)..(501): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagcgggccaggccctgtgtggtgatgtataaagacactgagaggccctagagggactcccgtgagcgtattcctcgtgctcgaggtcagggtacaacggtcacagttgccatcgagtggagtccaggcagaggacgnggntgactagttatgtanaatcaacagacacattggtacttagtgtactcggaactcgacgaacgacggtcaccgttccgcggtcacgccaacggccaaaccccngtacgtcacttccg

SEQ ID NO: 416782 - DNA, 491 bp, Homo sapiens
  misc_feature: GZ8MTXP02IDTPQ.51.35.D02.1.454.CMB.2.raw
  modified_base (238)..(238): a, c, t, g, unknown or other
  modified_base (282)..(282): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtacagcagaagccggcaggcccctgtgttggngatgtataaagacactgagaggccctgagggatcccgtgagcgattcctctggctcaggtcagggcacggtcacattggcatcagtgagtcaggcagaggacgtagctgactattattgtacaatcaacagacacattgtacttatgtctcggaactgcgacagtcacgtcgcggtcacgccaacggcccaacccgatcgtacactccg

SEQ ID NO: 416783 - DNA, 520 bp, Homo sapiens
  misc_feature: GZ8MTXP02ICDKM.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtaccagcagaagccggccaggcccctgtgttggtgatgtataaagacactgagaggccctgagggatccctgagcgattcctctggctccgaggtccgagggacaacgggtcacattggcatcagtggagtccgaggcagaggacgagctagacttagtattgtacaatcaacagacacattggtacttatgtcttacggaacttcgacgtacaacgttccaaccgtcgtacggtcacgcccgaacggacccaacccactcgtcactccg

SEQ ID NO: 416784 - DNA, 574 bp, Homo sapiens
  misc_feature: GZ8MTXP02GZ7LI.51.35.D02.1.454.CMB.2.raw
  modified_base (240)..(240): a, c, t, g, unknown or other
  modified_base (412)..(412): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaacgntatgcttatggtaccagcagaacgccggccacggcccctgtgtggtgatgtaataaagacactgagacggccctacgagggactcccgtgagcgtattccctctggctcgaggtcaagggacaacggtcactagttcggccatcgagtggatccgaggcaggaggacgaggntagacttattatgtacaaatacaaacctagaaccaactagttacggttaacttaagtcgttacgttacggaaacgttcgacgaaccgtaacggttccgaaccgttccgtacgggtaccaacgaacccgaacggacccaaacccactcgtaccacgtttcccg

SEQ ID NO: 416785 - DNA, 574 bp, Homo sapiens
  misc_feature: GZ8MTXP02G1JPZ.51.35.D02.1.454.CMB.2.raw
  modified_base (471)..(471): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttatggtaccagcagaagccgggcacggcccctgtgttggtgatgtaataaagacactgagacggccctcgagggactccctgagcgtattccctcgtcggctaccgaggtaccgaggggaccaaacgggtcacgtagtttcgggccaagtccgagttcgggaacgtccgaagggcaaggagggaccgagggtacctggaacttaagttacttgtacaatacaaanacgacaccgtagtttacggtaacttatcgtctacggaactgacgacacgtcaccgtctggtacacgcccgaacggacccaaccctacgtcgtacgacttcccg

SEQ ID NO: 416786 - DNA, 677 bp, Homo sapiens
  misc_feature: GZ8MTXP02JEKNY.51.35.D02.1.454.CMB.2.raw
  modified_base (242)..(242): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaccgntatgcttatggtaccagcagaagccgggcacggcccctgtgttggtgatgtaataaagcacgtgagacggcccctacgaggggactcccgtgacgcgtacttcccgtcgtcgggctccgaggtacgaaggggacctaaacgggtcaacgtacgttcgggaccagttcgaggtaggacgtacccgaaggcaaggacggaccggaggcgtagaacttagtttagttagtactaaattaccgaaacaacggtaaccaccgttaagtttacggttaactttaagttcggtttaccgttaacggggtaaacttcggaaccggtaaaccgtaaaaccgggttccgtaaacccggttccggttacggggtacccgaacggtaacccccgtaaacgggaacccccaaaaccccgtacgttaccggtacctaaccttttccccg

SEQ ID NO: 416787 - DNA, 518 bp, Homo sapiens
  misc_feature: GZ8MTXP02FFXEF.51.35.D02.1.454.CMB.2.raw
  modified_base (368)..(368): a, c, t, g, unknown or other
  modified_base (442)..(442): a, c, t, g, unknown or other
  modified_base (513)..(513): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtggttggtgatgtaataaagacactgagacggccctcgagggactcccctgagcgtattcctctggctcaggtcaggggcacggtcanatgcatcagtggagtccaggcagaggacgaggctgactattatgtcaatcaacagacacctattggtacttagngtacttcggaaactgaccgacgaaacggtcaccgtcgtcgggcacgcccgaaggcccaacccgctcgaccnctccg

SEQ ID NO: 416788 - DNA, 532 bp, Homo sapiens
  misc_feature: GZ8MTXP02F4DLV.51.35.D02.1.454.CMB.2.raw
  modified_base (238)..(238): a, c, t, g, unknown or other
  modified_base (285)..(285): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttattggtaccagcagaagccgggccaggcccctgtgttggngatgtataaagacactgagaggccctcaggactcccgtgagcgattcctctggctccgaggtcaaggggcaacggtcaacattggccatcagtggagtccaggcagagacgagctgactattatgtacaatcaacagaacaccattaggtacttatgtcttacggaactcgacgtaccaaaggtccaccggtcctaggggtccacgaacccgaacggacccaaaccccgtactcgacctacttcccg

SEQ ID NO: 416789 - DNA, 616 bp, Homo sapiens
  misc_feature: GZ8MTXP02JQXPP.51.35.D02.1.454.CMB.2.raw
  modified_base (222)..(222): a, c, t, g, unknown or other
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttatggtaccagcagagccggcacggccctgtgtgtgatgtataaagcactgagacggccctagagggactcccgtgacgcgtattcccgtcgtggcctaccgaggtcgaacggggactaaccgggtcaacgtagttcgggaccctagttcgagttgggacgtcccgagggacagggaggaccggaggcgtagacttaagtttattgtaactaactacaaacacgaaactaccgtaagtttacggttaactttacgtcgtttaccgttacggaaacttcggaccgtaaccgaaacgggttccaaccggttccgtacggggtaccaccggaacccgaacggaccccaaaccctcgtacgtacccactttcccg

SEQ ID NO: 416790 - DNA, 539 bp, Homo sapiens
  misc_feature: GZ8MTXP02JDOPU.51.35.D02.1.454.CMB.2.raw
  modified_base (310)..(310): a, c, t, g, unknown or other
  modified_base (322)..(322): a, c, t, g, unknown or other
  modified_base (418)..(418): a, c, t, g, unknown or other
  modified_base (436)..(436): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgatatgcttatggtaccagcagaagccgggcaggcccctgtgttggtgatgtataaagacactgagaggccctnagggactcccgngagcgtattcctctgctccgaggtcagggcaacggtcacgattggccatcagtgagtccaggcagagacgaggctgactattatgtacaatcaaanagacaccagttgtacttntgtacgttcggaaactcgacgaccaaacggtcctaaccgtccgtcgggactacgaacccgaaacggtacccaaaccccgtactacggttacccacgtttcccg

SEQ ID NO: 416791 - DNA, 784 bp, Homo sapiens
  misc_feature: GZ8MTXP02HXAF9.51.35.D02.1.454.CMB.2.raw
  modified_base (216)..(216): a, c, t, g, unknown or other
  modified_base (224)..(224): a, c, t, g, unknown or other
  modified_base (226)..(226): a, c, t, g, unknown or other
  modified_base (255)..(255): a, c, t, g, unknown or other
  modified_base (759)..(759): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatccaccgntctgagangnatgcaaaccgatatgtctattagtacagnagaaggccggccgacgccctcgtgttggtgatagtaagtaaacgtacactaggaggacggcccgtaccgacgggagttaccccgttcgaaggaccgtagtttacttcccgtagggtcctacccgaacgggttcgaacggggaaccgtacgggtaccgtactaacgttcggtaccgtacgtactacggggttacggacggtacccgagggcgaacggaaaggggtacggaccggggtattacggaaacttagtttacgtttaaggtttaccgaaaactttaaacccaacgtaaaaccgggaacttaaacccccgtaaaacggtttggtttaaacggttttaacgttacggtttaccgtttaaaccgggggaaacttacgggtaccgaaaaccgtaaaccggggttacccctaaccggttaccccggttcggggttaaccgaacccgaaaccccgggtaaaacccggacccccgtaaaaccccctaccgttacggtttaacccccncccggttttacctttaaccccccgg

SEQ ID NO: 416792 - DNA, 626 bp, Homo sapiens
  misc_feature: GZ8MTXP02HBFGO.51.35.D02.1.454.CMB.2.raw
  modified_base (242)..(242): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggtcaggatcacctgctctggagatgcattcgacccaaacgntatgtcttagttcggtaccagacaaggaacggcccgggccacggtccccgtggtgttggtgatgtaaataaagactactggacgacggccctacggacgggtactcccgtaggacgtcgtacttccgtcgtggtcctccggaggtcgaaggggacctacgggtacaccgtagttcggacctagttcgagtaggtacgccgaggacgaagggacggacggaggtacgtagtacttatttagttgtaacaactacgaaacgagaacctacgtagtttacggtacttagttcgtacgttacgaatcggaccgtaacgacggtaccgaccgtcgtacgggtaccacggaacccgaacggacccctaacccgcttcaccacgtttcccg

SEQ ID NO: 416793 - DNA, 514 bp, Homo sapiens
  misc_feature: GZ8MTXP02HLU4I.51.35.D02.1.454.CMB.2.raw
  modified_base (222)..(222): a, c, t, g, unknown or other
  modified_base (239)..(239): a, c, t, g, unknown or other
  modified_base (422)..(422): a, c, t, g, unknown or other
  modified_base (476)..(476): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaacgntatgcttattggtaccagcagaagccgggccaggcccctgtgttggtgatgtataaagcactgagacggccctcgaggggactcccctgacgcgattccgtctggctccgaggtcagggcaacggtcacattcggcatcagtgagtccaggcagagacgagctgactattatgtacaatcaanagacaccattaggtacttatgtctacggaactcgacgaccaggtcaccgttcgnggtcacgcccaacggcccaaacccgtcacgtcactccg

SEQ ID NO: 416794 - DNA, 628 bp, Homo sapiens
  misc_feature: GZ8MTXP02HQF5O.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccgggccacggcccctgtgttggtgatgtaataaagacactgagacggccctgagggactcccgtgacgcgtatttccctcgtggcctccgagggttccaaggggaccaaacgggtcaacgtagttcgggaccctatcgagtggaacgtcccgagggcaggaggacgaggcgtgacttatttattgtacaagttacaaacagaacaccgtagttacggttacttagtcgttacgttacggaacttcggaccgtaaaccgtaaacggtccgtaaacccgtttccggacggggttccaaccggtaacccccgaaaccgggaccccctaaacccccgtaacgttccggtaccctaacgtttcccccg

SEQ ID NO: 416795 - DNA, 640 bp, Homo sapiens
  misc_feature: GZ8MTXP02JMDEE.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccggccacggcccctgtgttggtgatgtaataaagacactagagacggccctagagggactcccgtagagcgtattccctcgtcggcctccgaggtacgaaggggacctaacgggtcaactacgttcggacctagtcgaggtcggacgtccgagggcaaggacggacggaggtctagtacttatttagttgtacaaagtacaaacgacgtaaccaaccgtagtttacggttaacttagttacgttaccgttacgggaaactcggtaaccgtaaccgtaaacgggtcctaaccggttcccgtacggggtacccaacggaacccgaaacccgggacccctaaaacccccgcgttaccggtacctaaccgtttccccg

SEQ ID NO: 416796 - DNA, 560 bp, Homo sapiens
  misc_feature: GZ8MTXP02GV0BH.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaaccgatatgtacttagttacggtaccagcgaagaacggcccgggccacggcccctgtgttggtgatgtaataaagacacgtgagacggcccctagagggactcccgtagacgtcgtattcctcgtgctccgaggtcgaagggaccacggtcacgtagttcggactagtcgaaggtgacgtcgaggcaagggacggacgaggtctagacttattagtgtacaattacaaacagaacactattcggtacttatgtacttcggaactgaccgactaacggtcaccgtcgacggtcacgccgaaacggcccacctagtcactactccg

SEQ ID NO: 416797 - DNA, 605 bp, Homo sapiens
  misc_feature: GZ8MTXP02JGMGC.51.35.D02.1.454.CMB.2.raw
  modified_base (237)..(237): a, c, t, g, unknown or other
  modified_base (447)..(447): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgtgctgacacagccaccctcggtgtcagtgtccccaggacagacgccaggatcacctgctctggagatgcattgccaaacgntatgcttattggtaccagcagaaggccgggccacggccctgtgttggtgatgtataaagacactgagacggccctacgaggggactccccgtagagcgtatttccctcgtggcctccgaggtcagggacacggtcacattggcctatcagtggactcgaggcagaggacgaggctgacgttatttaacgttgtaacaagttacaaaacgngtaaccaccgtaatttacgggtactttaacgttgttaccgttacggaaactcggtaccgtaaccgtaaacgggtccaccggttccgtacgggggttccaacgggtaaccccaaacgggacccccaaaccccgtacgttccggtacctaccgtttcccg

SEQ ID NO: 416798 - DNA, 565 bp, Homo sapiens
  misc_feature: GZ8MTXP02GXAOM.51.35.D02.1.454.CMB.2.raw
  modified_base (238)..(238): a, c, t, g, unknown or other
  modified_base (423)..(423): a, c, t, g, unknown or other
  modified_base (543)..(543): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccgggcaggcccctgtgtggtgatgtaataaagacactgagacggccctgagggatcccctgagcgtattcctctggctccgaggtcagggaccaacgggtcacgtattcgggccagtcagtggacgtcgaggcaggaggacgaggctagactattatgtanaagtcaaacagaaccacgtattcggtacttagtcgtacttcggaaacttcggaccgaacgtaacgggtccacccggttcgtacggtcaaccggaacccgtaaacggaccccaaaaccccnctacggtaccctacgtttcccg

SEQ ID NO: 416799 - DNA, 501 bp, Homo sapiens
  misc_feature: GZ8MTXP02FUC2S.51.35.D02.1.454.CMB.2.raw
  modified_base (238)..(238): a, c, t, g, unknown or other
  modified_base (362)..(362): a, c, t, g, unknown or other
  modified_base (404)..(404): a, c, t, g, unknown or other
  modified_base (429)..(429): a, c, t, g, unknown or other
  modified_base (488)..(488): a, c, t, g, unknown or other
tcagcgatcgtatacacgaccggtgctcgatttagcacacgatagttgggttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgctattggtaccagcagaagcgggccaggcccctgtgtggtgatgtataaagacactgagaggccctcaggggatccctgagcgattccctctggctccaggtcaggggcaaacgggtcanattgcatcagtgagtccagcagagacgagctgactatatgtnatcaacagacaccattggtacttangtcttcggaactgcgaccaaaggtccaccgtctcgggcacgcccaaggcccaaaccccncgtagccactccg

SEQ ID NO: 416800 - DNA, 526 bp, Homo sapiens
  misc_feature: GZ8MTXP02HUKC0.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgntatgcttatggtaccagcagaagccgggccaggcccctgtgttggtgatgtataaagacactgagaggccctgagggactccctgagcgtattcctctggctccgaggtccaagggacgaacggtcacagttcggccatcagtgagtccaggcagaggacgagctgactattattgtacaatacaacagaccactattgtactatgtcgtacgaactgacgaccacgtcctaccgtcgtcggtcacgaacccgaacggacccaaccccgactacgtactacttccg

SEQ ID NO: 416801 - DNA, 505 bp, Homo sapiens
  misc_feature: GZ8MTXP02HT0HN.51.35.D02.1.454.CMB.2.raw
  modified_base (399)..(399): a, c, t, g, unknown or other
  modified_base (409)..(409): a, c, t, g, unknown or other
  modified_base (412)..(412): a, c, t, g, unknown or other
  modified_base (414)..(414): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacgccaggatcacctgctctggagatgcattgaccaaacgatatgcttatggtaccagcagaagccgggccaggcccctgtgttggtgatgtaataaagacactgagacggccctgaggatcctgagcgattcctctggctcgaggtcgagggacaacggtcacagttgccatcagtggatccgaggcagaggacgagtcngactatattntanananananacactatagtatatgtcgtacgtactacgacgacgacgtacgacgtcgtcgtacgacgaaccgacgaccaccactactactactc

SEQ ID NO: 416802 - DNA, 627 bp, Homo sapiens
  misc_feature: GZ8MTXP02ILAC9.51.35.D02.1.454.CMB.2.raw
  modified_base (279)..(279): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttatggtacagcagaagccggcaggccctgtgtgngatgataaagcatgagacggccctcgagggactcccgtagagcgtatttccctcgtggcctacgaggtaccgagggaccgtaacgtacactagttcgggacctagtcgagtggacgtaccgaggacaaggaggacgtaaggtctagtaacttattaagttgtaacaaattccgaaacagaacctaaccgttagtttacggtaactttagttcgttaccgtttaacggaaaccttcggaaccgaaaccgtaacggttacccaacccgggtttccgtacgggggtaccaacccggtaacccgaaaccggaccccctaaaacccctacttcgtaccctaaccgtttccccg

SEQ ID NO: 416803 - DNA, 681 bp, Homo sapiens
  misc_feature: GZ8MTXP02H91L4.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtggagatgcattcgacccaaacgatatgcttattggtaccagcaggaacgccggcaggcccctgtggttgtgatgtaataaagacacgtgagacggcccctagagggtactcccgtgacgcgtattccgtcgtcggtctaccgaggtaccgaagggaccgtaaaccggggttacacgtagttcgggccctaagttccgacggttagggacgtaccgaagggccgaagggacggaccggaaggcgtaggtaaccttaagtttaacgttcgtactaaacgttacaaaaccgtaaggaacccaaccgttaagtttacggttaacctttaagttcggtttaccgtaacgggtaacctacggtacccgtaaaccggtacggttaccgacccgtttacggtcgggtaaccaccggtaaccccgaaacggaccccaaacccgtacgtaccgttcctaaccgtttcccg

SEQ ID NO: 416804 - DNA, 620 bp, Homo sapiens
  misc_feature: GZ8MTXP02I297U.51.35.D02.1.454.CMB.2.raw
  modified_base (240)..(240): a, c, t, g, unknown or other
  modified_base (282)..(282): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttatgtaccagcagaagccggcaggcccctgtgtggnatgtaataaagacactgagacggccctcgagggactcccctgagcgtattcctctgtctcgaggtcgagggccgaaacggtcacgtagttcggacctagttcaggttcggacgtccgaacgggcaagggaggaccggaggcgtaagacttatttagttacgttacaaacttacaaacgacgtaaccaaccgtagtttacggttaacttaagttcgttacgttacggaacttacggacgacccgtaaacgggtcccaaccggttcccgacgggttaccaacggaacccccgaaacggtacccccaaaacccgtccggttacgtaccctacgtttccccg

SEQ ID NO: 416805 - DNA, 670 bp, Homo sapiens
  misc_feature: GZ8MTXP02G2VC9.51.35.D02.1.454.CMB.2.raw
  modified_base (222)..(222): a, c, t, g, unknown or other
  modified_base (241)..(241): a, c, t, g, unknown or other
  modified_base (283)..(283): a, c, t, g, unknown or other
  modified_base (290)..(290): a, c, t, g, unknown or other
tcagcgatcgtatacacgaccggtgctcgatttagcacacgatagttgggtttgggggtgggtccaggaggcagaactctgggtgtctcaccatggcctggatccctttacttctccccctcctcactctctgcacaggctctgaggcctcctatgagctgacacagccaccctcggtgtcagtgtccccaggacagacggccaggatcacctgctctgganatgcattcgaccaaaccgntatgcttatggtaccagcagaagccggcaggccctgtgtggnatgtaanaaagcactgagacggccctgagggactcccgtagagtcgtattcctcgtggcctccgagggttcaggggtacacgggtcaactagtttccggcctataccgagggttacgacgttacccgaggacgaacgggaagggacgacgggtctaggtaacttatttaagttgtaaaccaagttaccgaaaacgtacggaaacctacccgttaagtttacgggttacctttaagttcggttaccgtttacggggaaaacttcggaaccgtaacccgaaaggttcccaaccggttcccgttagggggtacccaacccggaccccgaaaaccggggtcccccaaaacccccgtcgtaccggtacccaaccgtttacccgtttcccccg

SEQ ID NO: 416806 - DNA, 581 bp, Homo sapiens
  misc_feature: GZ8MTXP02IG33A.51.35.D02.1.454.CMB.2.raw
  modified_base (224)..(224): a, c, t, g, unknown or other
  modified_base (248)..(248): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctcgtgganatgctattcgaccaaacgatatgnttatgaccagcagagccggcacgccctgtgttggtgatagtaataaagacatgagacggccctgacggactcccgtgacgcgtattccctcgtcggctccgaggtcggaacgggaccaacggtacactagttcgcatcgagtgacgtccgaggcgaggacggacgaggacgtagtaacttattagttcgtacaacgtacaaacgtagaacctacgtagtttacgttaacttagtcgttacgttacgaacgttcgacgtaacgacgtaccgaccgttccgtacgtacaccgaacccgtaacgaccccaacccgtcgtaccgtcctacgttcccg

SEQ ID NO: 416807 - DNA, 574 bp, Homo sapiens
  misc_feature: GZ8MTXP02IZ4DG.51.35.D02.1.454.CMB.2.raw
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtacagcagagccggcaggccctgtgtgtgatgtataaagcactgagacggccctacgagggactcccgtgacgcgtattccgtactggctccgaggtcgaggggactaaacgggtcaacgtagttcgggccattcgaagtggagtccgaaggcaggaggacgaggctagactattagttgtacaatacaaactagaaccacctagttaggttacttaagttcgtacgttacggaaactcgacgtaaccaacgggttaccaccggtccgtacggggtaccaacgaacccgaaacggtccccaaacccgcgttacgctaccttccg

SEQ ID NO: 416808 - DNA, 517 bp, Homo sapiens
  misc_feature: GZ8MTXP02FG5P8.51.35.D02.1.454.CMB.2.raw
  modified_base (448)..(448): a, c, t, g, unknown or other
  modified_base (507)..(507): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactggagaggcccctcgacgggatccccgtgagcgtattcctctggctccgaggtcagggcaacggtcacatgcatcagtggacgtccgaggcagaggacgtaggctgactattatgtcaatcaaacagacacctattggtaacttangtcttacgaatcgcgaccaaggtccaccggtctacggcacgcccgaacgtcccaacccntcgtcactcc

SEQ ID NO: 416809 - DNA, 583 bp, Homo sapiens
  misc_feature: GZ8MTXP02FKAW3.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggcacggcccctgtgttggtgatgtataaagacacgtgagacggccctcgagggactcccctgagcgtattcctcgtgctcgaggtcgagggacaacgggtcatagttcggccatcgaaggtggacgtacccgaggcgaaggagggaccgaggctggactagtttattgtacaatacaacagtaacactagttagtacttatacttacgttacgaactcgaccgaactaacggtccaaccgtccgttggggacccaacggaaccccgaaacgggacccccaaaaccccgtccgttacggtaccctaaccgtttcccg

SEQ ID NO: 416810 - DNA, 572 bp, Homo sapiens
  misc_feature: GZ8MTXP02IOXOP.51.35.D02.1.454.CMB.2.raw
tcagcgatcgtatacacgaccggtgctcgatttagcacacgatagttgggtttggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttatggtaccagcagaagcgggccaggcccctgtgtgtgatgtataaagacactgagagccctcagggatccctgagcgatttcctctggctccaggtcaggggaccaagggtcacagttcggccatcagtggagtccaggcagagcgaggctgactattatgtacattacaacagaacacctattacggtacttagtgtacttacgggaaaacttcggaccgtaacctaaacggtacctacccggttcccgtacgggggttaccaacgggcccccgaaaacggggaccccaaaacccccctacgtaccggtttacccaacctttccccgg

SEQ ID NO: 416811 - DNA, 682 bp, Homo sapiens
  misc_feature: GZ8MTXP02FWL45.51.35.D02.1.454.CMB.2.raw
  modified_base (241)..(241): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgaccaaaccgntatgcttattggtaccagcagaacgccgggccaggcccctgtgttggtgatgtataaagcactggagacggcccctgagggactcccgtgagtcgtattcccgtcgtggctccgaggtacgacggggaccaacgggtcaacgtagttcgggacctagtccgaggtgggacgtcccgaagggccaaagggacgggaacgtagggctacgggtaaacttagtttaagttaggtactaaagtccaaaacgaacggaaccctaaaccgttagtttacgggtaaacctttaagtcggttaccgtttacgggtaaacttacggtaccgaaacccgtaaacggggttcccttaacccggttaccgtacgggggttaccaccggtaacccccgtaaaacgggaccccctaaaacccccgtacgttccggtaccctaacccgtttccccg

SEQ ID NO: 416812 - DNA, 582 bp, Homo sapiens
  misc_feature: GZ8MTXP02GYZK4.51.35.D02.1.454.CMB.2.raw
  modified_base (243)..(243): a, c, t, g, unknown or other
  modified_base (292)..(292): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgctattcgaccaaaccgntatgtcttattggtaccagcagaagccgggccacggcccctgtgttggngatgtataaagacactgagacggccctgacgggactcccgtgacgcgtattcctcgtggcctacgacggtcgagggacgaacggtcacgtagttcggaccatcgagtaggacgtaccgaggcgaggaggacggaggcgtagacttagttattcgactaatacaacagtaacacctagttacgtacttagtcgtacgttacggaactcggaccgtaacgtacggtccgaaccgttccgtacggtacaccgaaccgaacggaccccaacccgactcgtcctaacctttcccg

SEQ ID NO: 416813 - DNA, 601 bp, Homo sapiens
  misc_feature: GZ8MTXP02G697H.51.35.D02.1.454.CMB.2.raw
  modified_base (223)..(223): a, c, t, g, unknown or other
  modified_base (242)..(242): a, c, t, g, unknown or other
  modified_base (593)..(593): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacaggacggccaggatcacctgctctgganatgctattcgaccaaacgntatgtacttagtcgtaccagcagacggccggaccacggccctgtgtggtagatagtaataaagactacgtagacgacggaccctacggagggtacctccgtagacgtcgttattccccgtacgtcgtccgtaccgtaggtacggaacgggaccgtacggttacaacgtagtccggactagcgagtgacgtccgaggacaggacggtacgatgtaacgtattagttagtacgaaactacgtaaacacgtaacaactaacgttaggttacttacgttagttcggtacgtacgagtcgaaccgacgtacgccgtacgtccgtcgaccgacgaaccgacacccactgacctaccncgttaccc

SEQ ID NO: 416814 - DNA, 653 bp, Homo sapiens
  misc_feature: GZ8MTXP02HH6HX.51.35.D02.1.454.CMB.2.raw
  modified_base (287)..(287): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggccctgtgttggngatgtaataaagacactgagacggccctgagggactccccgagcgtattctccgtggcctccgaggtcacggggaacacgggtcacgtagttcggaccctatcgaggtgggacgtcccgagggcgaagggacgggaacggacgggctacggtaacttattagttcgtactaaactacgaaaacacggtaaacctaaccctaagtttacggttaactttaagttcgttaccgtttacggggaaacttcggaccgtaaacccgtaaacgggtcccgtaaccggttcccgttacggggtaccaacggaccccgtaaaacggacccccaaaccccgtaacgtaccgtacccaaccgttccctttaccccg

SEQ ID NO: 416815 - DNA, 635 bp, Homo sapiens
  misc_feature: GZ8MTXP02JYZ8B.51.35.D02.1.454.CMB.2.raw
  modified_base (260)..(260): a, c, t, g, unknown or other
  modified_base (297)..(297): a, c, t, g, unknown or other
  modified_base (332)..(332): a, c, t, g, unknown or other
tcagcgatcgtatacacgaccggtgctcgatttagcacacgatagttgggtttgggggtgggtccaggaggcagaactctgggtgtctcaccatggcctggaccctctacttctcccctccctcactctctgcacaggctctgaggcctcctatgagctgacacagccaccctcggtgtcagtgtcccaggacagacggccgaggatcacctgctcgtggagatgcattcgaccaaaccgatatgtcttattggtaccancgagaggccggccgagccccgtgtgttggtgatgtanaaagacactgagacggcctcgagggctccctgagngattctcgtcggctcccagggtcgacgggtaacaccgggtcacgtagttcgggcctaaactcgaggttagggacgtaccgacgggacgaggaacgggacgacgggtacgtagtacttatttagtttacggtacaaatcaaacacggtacaacccttagttacggttaactttagttgtacgtttaccggtaacgtacgacccggtaaaaccgaacgggtacccttaacccggtcggttacgggtaccgaaccgtaccccgaacggtaccccaaccccacggttcgtcacccgttctttcccgg

SEQ ID NO: 416816 - DNA, 614 bp, Homo sapiens
  misc_feature: GZ8MTXP02F77JX.51.35.D02.1.454.CMB.2.raw
  modified_base (239)..(239): a, c, t, g, unknown or other
  modified_base (283)..(283): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatgtacagcagagccggcagccctgtgtgtgatgtanaaagcactgagacgccctagagggactcccgtgagcgtattcccgtcgtcggctccgaggtccgaggggacaacgggtcactagttcggacctatcgaggttggacgtccgaagggcgaaggacggacggacggctgaacttatttagttacgtacaaacttacaaacgaacgtaacctaacccgtaagtttacggtaacttttaacgtggttaccttacgggaacttcggacccggaactaacggtccgaaccgttccgtacggggtaccaccggaaccccgaaacggtaccccaaaaccccctacgttaccggtaccaccgtttccccg

SEQ ID NO: 416817 - DNA, 509 bp, Homo sapiens
  misc_feature: GZ8MTXP02JGVZS.51.35.D02.1.454.CMB.2.raw
  modified_base (237)..(237): a, c, t, g, unknown or other
  modified_base (307)..(307): a, c, t, g, unknown or other
  modified_base (414)..(414): a, c, t, g, unknown or other
tcagcgatcgtatacacgaccggtgctcgatttagcacacgatagttgggtttggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtaccagcagaagccggcaggcccctgtgtggtgatgtataaagacactgagaggccctnagggatccccgtgagcgattcctcgtggctccaggtcagggcaacggtcacattggccatcagtggagtccaggcagagacgaggctgactattattgacaatcaanagacacctattggtacttatgtacttcggaactcgacgaaccaggtcacgtctacgggtcagcccgaaggacccaacccacgtcgtcacgttccg

SEQ ID NO: 416818 - DNA, 700 bp, Homo sapiens
  misc_feature: GZ8MTXP02INE8O.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctggagatgctattgaccaaacgatatgtcttatggtaccagcagaacgccggccacggccctgtgtggtgatagtaataaagacagtgagacggccctagacggtactcccgtagacgtcgtacttcccgtcgtcggtcctacgaggttaccgaaggggacccgtaacgggttacaacgtacgttaccggacagttaccgtagggtacggacgtacccgaggggacgtaagggaacgggacggaacgggtacgtaacgtaactttagtttaacgtttacgtacctaaaacttaccgaaaacgaacgtaaccctaaccgtaaggtttaacggttaactttaacgttacgtttaaccgtttacggaaaaccgtttcggaaccgtaaaccgtaaacggttacccgtaacccggttccggtcggtaacccacccggaaccccgtaaacgacccccgaaccctacgtaccgttacctaccgttccccg

SEQ ID NO: 416819 - DNA, 543 bp, Homo sapiens
  misc_feature: GZ8MTXP02GHD7U.51.35.D02.1.454.CMB.2.raw
  modified_base (240)..(240): a, c, t, g, unknown or other
  modified_base (286)..(286): a, c, t, g, unknown or other
  modified_base (432)..(432): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccaggcccctgtgttggnatgtataaagacactgagaggccctgagggactccctgagcgattcctcgtggctccgaggtcgagggacaacgggtcaactagttcggccatcagtggagtccgaggcagaggacgaggctgactattaattgacaatacgaaanagtaacacctagttaggtacttatgtacttcggaacttcgaccgacaaaggtccaccggtcctcgggtacacgaacccgaacggacccaaacccgactcgccacgttcccg

SEQ ID NO: 416820 - DNA, 545 bp, Homo sapiens
  misc_feature: GZ8MTXP02JX54N.51.35.D02.1.454.CMB.2.raw
  modified_base (434)..(434): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaacgatatgcttattggtaccagcagaagccgggccaggcccctgtgttggtgatgtaataaagacactgagaggccctgagggactccctgagcgattccctgtggctcgaggtcgagggacaacgggtcacgtagttcggcctatcagtggacgtccaggcaaggaggacgagctagactattagtgacatacaanagaacacagttaggtacttatcgttacttagaactcgacacgaaacggtccaccgttcgtcgggtacacgaacccgaacggacccaacccgtactcgtaccacgtttcccg

SEQ ID NO: 416821 - DNA, 847 bp, Homo sapiens
  misc_feature: GZ8MTXP02FIIRN.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgtcttattggtaccagcagaacgccgggccacggcccctgtgttggtgatgtaataaagacactggagacggccctcgagggactcccgtgagtcgtattcccgtctcggctaccgacggtacgaacggggtaccaaaccgggttcaaacgtacgtttcggggacccaagttacccgaaggggttacggggaacggttcccccgaaaggggcccgaaagggggaaacggggtaccgggtaaacggggcccgttaggggaaaacccttttaagttttaaagttacggttaaaccgtaaaacgttaccaaaaccggtaaaccgggaaaaccctaaacccccgttaaagtttacgggggtttaaaccttttaaacgttcggggtttacccgttttaaacccgggggaaaaaccgtttccgggggaaaccccgtaaacccgggttaaaaaccggggttccccgttaaaacccccggggtttcccccgggttacgggggttaccccgaaaacccggggaacccccccggtaaaaacccgggggaaccccccctaaaaaccccccggtaaccgttaccggttaccccctaaacccggttttacccccccgg

SEQ ID NO: 416822 - DNA, 524 bp, Homo sapiens
  misc_feature: GZ8MTXP02JT34E.51.35.D02.1.454.CMB.2.raw
  modified_base (219)..(219): a, c, t, g, unknown or other
  modified_base (241)..(241): a, c, t, g, unknown or other
  modified_base (282)..(282): a, c, t, g, unknown or other
  modified_base (287)..(287): a, c, t, g, unknown or other
  modified_base (293)..(293): a, c, t, g, unknown or other
  modified_base (306)..(306): a, c, t, g, unknown or other
  modified_base (420)..(420): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggtcaggatcacctgctcnggagatgcattgaccaaaacgntatgcttatggaccagcagaagccggcaggccctgtgtggnatganaaaganactgagagccctnagggatcccgtgagcgattcctcgtgctccgaggtcaggggactaacggtcactagttggacccatcagtggatccgaagcaaggagacgagctgactattatgtcaaatcaanagtacacaattggtaactatgtcttacggaactgacgacctaaggtccaaccgttccgagggtcaacgcccgaaacggcccaaaaccccacgtcgtacactccg

SEQ ID NO: 416823 - DNA, 690 bp, Homo sapiens
  misc_feature: GZ8MTXP02F73I3.51.35.D02.1.454.CMB.2.raw
  modified_base (288)..(288): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgatatgcttattggtaccagcagaacgccgggccacggcccctgtgttggngatgtaataaagacactggagacggcccctcgagggactccccgtgacgcgtattccgtacgtcggctaccgaggtaccgaaggggacctaaacgggtccaaacgtagttacgggaccctagtccgaagggtcggacgtcccgaaggcgaaaggagggaaccggaggtcctaggtaaaccttaagttaacgtttacggtaacaaaattacaaaacgacgaaacctaacccgtaagttttacgggtaacctttaagtcgttaccgttaacggaaaacgtcggtaaccggtaaccgtaaacggggttacccaaccccggttccgtaacggggtcccaaaccggaaccccgaaaaccgggaccccctaaaacccccgtacgttacggtaacccacctttccccgg

SEQ ID NO: 416824 - DNA, 581 bp, Homo sapiens
  misc_feature: GZ8MTXP02HXXI3.51.35.D02.1.454.CMB.2.raw
  modified_base (225)..(225): a, c, t, g, unknown or other
  modified_base (434)..(434): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctcgtgganatgcattcgaccaaacgatatgtacttattggtaccagcagaacgccgggccacggccctgtgttggtgagtgtaataaagacacgtggagacggccctagaggggactcccgtagacgcgtacttccgtcgtcggctcgagggtcgaagggcgaacggtcacgtagttcggactatcgagtggacgtccgaggcgaagacggacgagntagacttattattgtacaataacaagacgaaccacgttagttaggttacttgttacgtcgttacgaacgtcggacgaccgtaacggtctaaccgtcgtacggtccacgaacccgaacggacccacccgtactcgtacctacgttccc

SEQ ID NO: 416825 - DNA, 782 bp, Homo sapiens
  misc_feature: GZ8MTXP02G4G1I.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttatggtaccagacagagccgggccacggcccctgtcgttggtagatagtaataaagacacgtagacggacggtccctacgagggacttcccgtagacgtacgtacttccccgtcgtcggtacctaccgtacggtccgaaggggaccgtaaccgggtacgaaaccgtagttaccgggaccctacgtacgtaacggtcggtaaccgtacccggaagggacccgaaaaggggaccgggaaaccgggtaacgggtaccgttacgggtaaaaccttttaaagttttaagtttacggttaaacctaaaacgtttaaccaaaaccgtaaccggtaaaacccgtaaccctttaaaggtttacgggttttaaacctttaaggtttaccggtttaccgtttaaaacggggtaacctaccgggtaaaccgaaccgttaaaaccggggtcctaaaccccgggttccgtaccgggtaccgaaaccggaaccccgtaaaaccggaccccccgtaaacccctaacgtccggttaaccaacgtttacccccg

SEQ ID NO: 416826 - DNA, 578 bp, Homo sapiens
  misc_feature: GZ8MTXP02GK76P.51.35.D02.1.454.CMB.2.raw
  modified_base (284)..(285): a, c, t, g, unknown or other
  modified_base (316)..(316): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgtcttattggtaccagcagaacgccggcacgccctgtgtgnntgataagacatgagcgccctgaggctcccgngagcgattcctctggctcgaggtcaaggggacaacgggtcactagttcgaccatcgagtggacgtccgaaggcaaggaggacgaggactgaacgttatttagtctacaaatcaaaacagaacaacctagttagtaaccttatcgttacgttacgaaactcggaccgaaaccgaacgggttccaacccggttccgtacggggtaccaaccggaacccgaaacggacccccaaaaccccggcttacggaccctaacgttccccg

SEQ ID NO: 416827 - DNA, 647 bp, Homo sapiens
  misc_feature: GZ8MTXP02IB7W8.51.35.D02.1.454.CMB.2.raw
  modified_base (275)..(275): a, c, t, g, unknown or other
tcagcgatcgtatacacgaccggtgctcgatttagcacacgatagttgggtttggggagctctgggagacgagccccagcactggaagtcgccggtgtttccattcggtgatcatcactgaacacagaggactcaccatggagtttgggctgagctgggttttcctcgttgctcttttaagaggcgtccagtgtcaggtgcagctggtggaggtcggtggggggggcgtgggtccaggcgtggggaggtccctgagactctcctgtgcagcctcnggattcaccttcacgtacccatagaaatgcacgtcgggtccgccaggcctcgaggcgaaggggctggagtgggtggctagttacacgtacctagtgagtaggaacgtcaaagtaagaccaacgtacgacgaagtacgtacccggtaggaaccggggtaccgtagttacgaaccctattccgacaacgacggaacctaaactacggaaagttaaacgtacggtttacttactaaacgaaagtcgaaaacgcgaccgtaggaagagtaccaggaacggtaacgacggtaccttaaagttacgtttttacgaggttacgaccggtaagggtaacggtaaccgttaggtaacttaccgaaacgttccgaaacccgg

SEQ ID NO: 416828 - DNA, 628 bp, Homo sapiens
  misc_feature: GZ8MTXP02I81BQ.51.35.D02.1.454.CMB.2.raw
  modified_base (225)..(225): a, c, t, g, unknown or other
  modified_base (290)..(290): a, c, t, g, unknown or other
  modified_base (294)..(294): a, c, t, g, unknown or other
  modified_base (301)..(301): a, c, t, g, unknown or other
  modified_base (328)..(328): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggactcacctgctcgtgganatgctattcgaccaaacgtatatgtacttagttcgtaccagcagacgccggcacgccctgtgtgngatntaataanacagtaggagcggcctgacggctccgngacgtacgtacttccgtcgtcggtctaccggtacggtacgaagggtaccgtacggtactacgagtcggacctagtacgaggtggaacgtacgacggacgaaggacgggaggacggcgttagaactttagttacgttacgtaactaaactacaaaacgacgtaactacctagtttacgtaacgttatcgttacgtacgggtactacggacccgacggtaacggtcctaaccggttccgtacggtccgtaaccgaacccgaacggtacccccaaaccgtactacgtaccctacgtttccccg

SEQ ID NO: 416829 - DNA, 739 bp, Homo sapiens
  misc_feature: GZ8MTXP02J23JD.51.35.D02.1.454.CMB.2.raw
  modified_base (303)..(303): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgacggcctcctatgagctgacacacgcccacccgtcggtgtcagtcgtccccgaggacagacgccaggactcactgctgtggagatgctatcgaccaaacgatatgtacttagtcggtaccagacaaggacggcccgggcaccggccctggtgttggtnagtagtaaagtaaacgactacgtggacggacggtcccctaggacgggtacctcccgaggtacgtccgtacttcccgtcggtcggtcccgtaccgaggggtaccggaacggggtaccgaaccgggttacaacgtagttccgggaacccttagtaccggtagggtacggggtaccgtacccgggaaagggccgaaagggtacggggaaccgaggggtactagggttaaactttaagtttagtttacggaaactaaacgttaccgaaaacgaaccggtaaacttaccgtaagtttttacggtaaccttttaagtcgtttaccgtaaccggtaaagtccgaccggtaaaccgtacgggtaccctaccggtcccggtcggaacccgaacccggaaccccgaaaccggacccaaccccgttagtccgtaccttacgtccccg

SEQ ID NO: 416830 - DNA, 576 bp, Homo sapiens
  misc_feature: GZ8MTXP02FZOK8.51.35.D02.1.454.CMB.2.raw
  modified_base (239)..(239): a, c, t, g, unknown or other
  modified_base (563)..(563): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggcaggcccctgtgtggtgatgtataaagacactgagacggccctcgagggactccccgtgagtccggtatttcccgtctcgggcctccgagggtcgacggggacctaacgggtcacgtagttcggacagtcgagtggacgtccaaggcaggaggaccggagcgtagacttattagttacgtacaagtacaaactacggaactaaccagtttacggttacttaagtcgttacgttacggaaacttgaccgtacgaacgtccgaccgtcgttcggacacgaaccgacggacccacccnctcgccacgttcc

SEQ ID NO: 416831 - DNA, 646 bp, Homo sapiens
  misc_feature: GZ8MTXP02JPY2O.51.35.D02.1.454.CMB.2.raw
  modified_base (223)..(223): a, c, t, g, unknown or other
  modified_base (242)..(242): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtgganatgctattcgaccaaacgntatgtcttatggtaccagcagaacgccggccacggcccctggtggttggtgatgtaataaagacactgagacggccctacggagggtactcccgtagacgtacgtacttcccgtcgtcggtccgtaccgtaggtacggaacgggtaccgtaacgggtaccaacgtagttcggacctacgtcgaaggtcggaacggtcgacggacgaagggaacggacggaggcgtaagtacttaagttagttacgtaacaactacaaacacgactaacctagttacgttacttattagttaccgtacggtaactcggaccgtaccggtaaacgtccgtaaccggtccgtacggtaccaccggaaccccgaaccggtacccccaacccgtacgttaccgtacctacctttacccg

SEQ ID NO: 416832 - DNA, 703 bp, Homo sapiens
  misc_feature: GZ8MTXP02FM52L.51.35.D02.1.454.CMB.2.raw
  modified_base (243)..(243): a, c, t, g, unknown or other
  modified_base (288)..(288): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccacccttggtgtcagtcgtccccaggacagacggccaggatcacctgctcgtggagatgctattgaccaaaccgntatgcttagttggaccagcagaagccggccacgccctgtgtgganatagtaataagacacgtgaagcggccctagaggtcctcccgtgacgtcgtattcctacgtcggctaccggtaggtaccggaacgggtaccgaaccggttcaacgttacgttacggacctagttaccgagtacgggacgtaccgaaggcgaaagggacggacggtaggactaggtaaacttatttacttggaactaaataccaaacgaacgaaccttaaccgtaagtttacggtttaaactttacggtacgtttaccgggtttaaaccgaacttacggggtaccccgaaaccgtaaagggttacccccgaaccccggtttccggtaacccgggggttaccaaccccgtaaccccggtaaaacccggtacccccaaaaacccctccgtttaccggaccctttaaccctttaccccgg

SEQ ID NO: 416833 - DNA, 739 bp, Homo sapiens
  misc_feature: GZ8MTXP02IQ1LF.51.35.D02.1.454.CMB.2.raw
  modified_base (227)..(227): a, c, t, g, unknown or other
  modified_base (246)..(246): a, c, t, g, unknown or other
  modified_base (290)..(290): a, c, t, g, unknown or other
  modified_base (294)..(294): a, c, t, g, unknown or other
  modified_base (504)..(504): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctcgtggagntgctattcgacccaaacgntatgtacttagttgtacagcagacgccggcacggccccgtgtgnagtntaataagacacgtgagacgcctacgaggctcccgtgacgtcgtagttcctaccgtcgtcctccgtacggtacgaacgggaaccgacgggtacacgtacgtacgggaccctagtacgtagggtacggtacgtaccgagggaccgaaggaacggggaccggtaggtacgttacgggtaaacctttaagttacgtttacggtaaccgttaaanaacccgtaaagaaacggtaacctaaccgttagtttaaccggttacgttttaacgtacggtttaccgttacggtaaacgtaccggtaaccgtaacccggtaaaacggtttcccaacccgggttccggttaacccgggttacccggtaaccccgaaccccggaaacccgggtacccccaaaacccccgtttacggtacccttaccccgttaaccccgttaccgttttacccccccgg

SEQ ID NO: 416834 - DNA, 674 bp, Homo sapiens
  misc_feature: GZ8MTXP02HKZBV.51.35.D02.1.454.CMB.2.raw
  modified_base (223)..(223): a, c, t, g, unknown or other
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctgganatgcattgaccaaacgntatgtcttattggtaccagcagaacgccgggccacggcccctgtgttggtgatgtaataaagacactgagacggccctagaggactcccgtgacgcgtattcctcgtgcctaccgaggtcgaacgggaccgaacggtcaactagttcggaccagtcgagtggacgtccgaggacgaggacggacgaaggcgtagtacttaatttattagtacaaattaccaaacgacgaacctaaccgtagtttacggtaactttagttacgtttacgtttacgggaaaccttacggacccgtaaaccgaaacgggttaccccgtaaacccggttcccggtttacggggtaccctaaccggtaacccccggtaaaacccgggtacccccccaaaacccccgtaccgtttaacccggtaccccgtttaaacccttttacccccgg

SEQ ID NO: 416835 - DNA, 511 bp, Homo sapiens
  misc_feature: GZ8MTXP02GVMCV.51.35.D02.1.454.CMB.2.raw
  modified_base (218)..(218): a, c, t, g, unknown or other
  modified_base (235)..(235): a, c, t, g, unknown or other
  modified_base (247)..(247): a, c, t, g, unknown or other
  modified_base (251)..(251): a, c, t, g, unknown or other
  modified_base (264)..(264): a, c, t, g, unknown or other
  modified_base (298)..(298): a, c, t, g, unknown or other
  modified_base (302)..(302): a, c, t, g, unknown or other
  modified_base (308)..(308): a, c, t, g, unknown or other
  modified_base (320)..(320): a, c, t, g, unknown or other
  modified_base (327)..(327): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccctcctcactctctgcacaggctctgaggcctctatgagctgacacagccacctcggtgtcagtgtccccaggacagacggccaggatcactgctctgganatgcattgcaaacgtangctatgacagcngaancggcaggccctgngtgtgaatgtacaaagacagtgagtaggcccctnaggntcccgngagctatccctntcgcacngcgagcgacgacacatgcactacgagtagagacagacgagagacgagacgtagactatatagtatatacaacacgacaacgactacgtacgttacgtagtacgtacgtaacgtacgacgacgaacgtacgtacgtacgtacgtacgacgaaccgaacgaccgacccaccgtacgtactactacg

SEQ ID NO: 416836 - DNA, 618 bp, Homo sapiens
  misc_feature: GZ8MTXP02GVJTP.51.35.D02.1.454.CMB.2.raw
  modified_base (223)..(223): a, c, t, g, unknown or other
  modified_base (276)..(276): a, c, t, g, unknown or other
  modified_base (281)..(281): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgganatgcattcgaccaaacgatatgcttatgaccagcagagccgggcaggccctgngttgngatgtataaagcactagagaggccctgagggactccctagacgcgtacttcctcgtgctccaggtcacgggacaacgggtcactagttcggccatcgagtgacgtccgaggcaagagggaccgaggctagtattagttacttagtacaacttacaaacgagtaacctaccttaagttacggttaattaacgttgttacgtttacggaaacttcggacccggtaaaccgaaacggttcccgtaaacccgttccgtcggggttacctaaccggggaacccctaaaaccgggaacccccaaaccccggtaacgtccgtaacccgtcccgttttaaccccg

SEQ ID NO: 416837 - DNA, 658 bp, Homo sapiens
  misc_feature: GZ8MTXP02F759Q.51.35.D02.1.454.CMB.2.raw
  modified_base (345)..(345): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgtcttattggtacagcagaacgccgggccaggcccctgtgttggtgatgtataaagacactgagacggccctgagggactcccgtagagcgtattccctcgnggctcgaggtcagggcaacggtcacagttggaccatcgagtggacgtccgaggcaaggacggacgagggctaggaacttagtttaagttcgtaactaaacgttacaaaacgtacggtaacctaaacccgttagtttacgggttaaacctttaaagttcggttaacctttacggggtaaaacttcgggaacccgtaaaccggtaaacgggttaccctaaacccggttcccggttacggggtaccaaacccggaaccccgaaaacggcccccctaaaaaccccgtcgttaccggtaccctaacccttttccccgg

SEQ ID NO: 416838 - DNA, 736 bp, Homo sapiens
  misc_feature: GZ8MTXP02GCUHT.51.35.D02.1.454.CMB.2.raw
  modified_base (179)..(179): a, c, t, g, unknown or other
  modified_base (243)..(243): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggatcacctgctcgtggagatgcattcgaccaaacgtntatgtcttagttcggtaccagcaggaacgccgggccacggtcccctgtaggttggcgtatgtaataaagccatggagacggccctagagggactcccgtagagcgtatccctgtacggtctacgacggtcgagggaccgaacgggtcacgtacgttccgaccagttccgaggtggaccggtaccgaggacgtaacggggagaccgggaacgggtcctaggtaacctttagttaacgttacggtactaaactaccgaaaaacgtaccggaaccttaaacccgaggtttttaacccggtaatttaaacttcgggtttaaccgtttaccgggaaaacgtttccgggacccggtaaacccgtaaaccgggggtttaccctaaacccccgggttccggtttacggggtaaccctaacccgggtaaccccggaaacccgggtttaaaccccccaaaacccgtacgtttacccgggtacccttaacccggttttcccccg

SEQ ID NO: 416839 - DNA, 614 bp, Homo sapiens
  misc_feature: GZ8MTXP02HPFJX.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgatatgcttattggtaccagcagaagccggccaggcccctgtgttgtgatgtataaagacactgagaggcccctgagggactcccgtgacgcgtattcctctggctcgaggtcagggcacggtcacagttcgcatcagtggagtcccaggcagaggacgaggctgacttattagtcgtactaacttcaaacgtacgaacctaccgtagtttaggtaaactttgtacggttaccgtttacgggaacgttacggccggttaacccgaaacgggttccgaaaccccggttcccgttacggggtaacccgtaccgggaacccccgtaacggggtaacccccaaacccccgtacgttaccggtacctaaccctttccccg

SEQ ID NO: 416840 - DNA, 645 bp, Homo sapiens
  misc_feature: GZ8MTXP02GD1ZB.51.35.D02.1.454.CMB.2.raw
  modified_base (239)..(239): a, c, t, g, unknown or other
  modified_base (285)..(285): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaacgntatgcttatggtaccagcagaagccggccacggcccctgtgttggngatgtaataaagacactgagcggccctagagggtactcccgtagagcgtattccctcgtggtctccgaggtacgaacggggaccaaacgggttcaacgtagtttcgggaccctagttaccgaggtaggtacgtcccgaagggcaagggaggaccggaggccgtagtaacttaagtttattcggttacaaattacgaaactaacggaacctaacctagtttacgggttaacctttaagttcgttaccgtttacggaaaacttcggacccggaaacgtaacggtaccgaacccgttccggtacgggtccaacggaaccccgaaaccggacccaaaccccacgtacgtaccacctttaccccg

SEQ ID NO: 416841 - DNA, 639 bp, Homo sapiens
  misc_feature: GZ8MTXP02JMNZ6.51.35.D02.1.454.CMB.2.raw
  modified_base (243)..(243): a, c, t, g, unknown or other
  modified_base (286)..(286): a, c, t, g, unknown or other
  modified_base (624)..(624): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacgaccaggatcacctgctcgtggagatgctattcgaccaaacgntatgcttatggtaccagcagaagccggcacggccctgtgtggnatgtataaagcactgagacggccctgacggtactcccgtagagtcgtattcccgtcgtcgggtacctaccgagggtcgaacggggtaccgtaaacgggttacaaccgttagttcgggaccctattaccgaaaggttcgggtaacgttacccgaaggggccaaaggggacggtaccggaaggggtcctaggtaacttaaggtttatttcggactaaacggttaccaaaacgtacgaacctaccgtagtttacggttacttaagttcgtacttacgggaacttcgacgtaaccgagttccgaccgttcgtacggggcacgcccgaaacgccccaaaccgntccgtaccacttccc

SEQ ID NO: 416842 - DNA, 718 bp, Homo sapiens
  misc_feature: GZ8MTXP02H737J.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacaggacgccaggatccacctgctcgtggagatgcattcgaccaaacgatatgtacttagttcggacagcaagacggcccgggccgacggtcccctggttcggttggtagtagtagtaaagtaaacgactaacgtaggaaggaccggccccgtaggaacgggtctcccctaggacgtcgtacgttcccttcgtcggtccttaccggacggttacgaacggggtacctaacgggttacaacgttacggttcggaccctaagtacgtaggtacggaccgtacgagggacaaggggacggacggtaaggctacgtattactttagtacgtaactaagtaccaaacgacgaacctaccgttagtttacggttaactagttacgtacgttaacggtaaccgtacggtacccgtaaccggtaacggtacccgttaccccggtacggtaccgggttaccgacccggtaacccccgaaaccgtacccccaaacccccggttactaccggttaaccttcccgtttaccccgg

SEQ ID NO: 416843 - DNA, 651 bp, Homo sapiens
  misc_feature: GZ8MTXP02G7TZG.51.35.D02.1.454.CMB.2.raw
  modified_base (248)..(248): a, c, t, g, unknown or other
  modified_base (300)..(300): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccacctcggtgtcagtcgtccccaggacagacggccaggatccacctgctcgtgggagatgctagttcgacccaaacgtntatcgtcttagttcgtaccagcagaacggccgggcacggccctgtggttggngatgtaataagacacgtgagacggcctacggaggtctcccgtgacgcgtacttcccgtgtacggcctaccgagggtaccgaacggggtaccaaaccgggttcaaacgttagttacgggcctaatccgaggtacggtacgtaccggacgggacgaagggaacggacggacggtacgtacggtacgtttaatttacggtataacaaacgtacaaacgtacggactaccgtagtttacggtacttagtcgttacgtacgacttcggaccgtaacgtaaccgtcgtaccggtcgttcggggacctaccgaaccgaaaccggccctaacccgtactccggtacctaccgtttcccg

SEQ ID NO: 416844 - DNA, 661 bp, Homo sapiens
  misc_feature: GZ8MTXP02J1077.51.35.D02.1.454.CMB.2.raw
  modified_base (229)..(229): a, c, t, g, unknown or other
  modified_base (247)..(247): a, c, t, g, unknown or other
  modified_base (294)..(294): a, c, t, g, unknown or other
  modified_base (300)..(300): a, c, t, g, unknown or other
  modified_base (308)..(308): a, c, t, g, unknown or other
  modified_base (323)..(323): a, c, t, g, unknown or other
  modified_base (327)..(327): a, c, t, g, unknown or other
  modified_base (418)..(418): a, c, t, g, unknown or other
  modified_base (447)..(447): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacacgcccacccgtggtgtcagtcgtccccgaggacaggacggccaggactcacctgctgtggagntgctattcgaccaaacgntatgtacttagtcggtacagcaagacgccggcacggccctgtgtgtnataganaagctagngagcgcctagaggcnccgngagtcgtattcccgtcgcgctcgaggtacgacggacgacggactacgtgtcgcaactgagtggacgtcgaggacgtaggagggagacggtntaacggtacttaattgttactacgtaaanaccaaacgacgtaaacccacttaacggttttagtaacccgttttagtaccggtttcgttaacccggtaaacgttcggaaacccgtaaaccggttaaacggtccccgttaccggttaccggtaaccgggttcccgaaacccggggtaaccccgaaaacccgggttaacccccaaacccccgttacgttaccggtaccctaacccgtttccccccg

SEQ ID NO: 416845 - DNA, 657 bp, Homo sapiens
  misc_feature: GZ8MTXP02G7ZOC.51.35.D02.1.454.CMB.2.raw
  modified_base (217)..(217): a, c, t, g, unknown or other
  modified_base (221)..(221): a, c, t, g, unknown or other
  modified_base (239)..(239): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcagtcgtccccaggacagacgccaggatcacctgctcngganatgctattgaccaaacgntatgcttatgtaccagcagacgccggcacggccctgtgtgtgagtagtaataaacgacacgtagaggacggtccctagacggtactccctaggacgcgtatttcccgtacgtcggtccgtaccgacgggtacgaacggggaccgtaaccgggttacaaccgttaaggttccgacgacgtacgtaggtacggacgtaccggaggaccgtaaagggacgggaaccggacggtagttacgtaaacgtttagttattacgttaaccaaagttacaaaactacggaacccaaccttagttacggttacctttagtcgttaccgtacgtaaacgtcgaaccgtaacgtaacgggtaccaacccgtcgtacggtacgaacgaaccccgaacgaccccaaacccgttataccgtacctaccgtccg

SEQ ID NO: 416846 - DNA, 658 bp, Homo sapiens
  misc_feature: GZ8MTXP02JLPST.51.35.D02.1.454.CMB.2.raw
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtccccaggacaggacggccaggatcacctgctctggagatgcattcgacccaaacgatatgtcttattggtaccagcagaacgccgggccaggcccctgtgttggtgatgtataaagacactgagacggcctacgacgatccctgacgcgtattccctcgtcggtcctccgaggtcgagggaccgaacgggttacacgtattcgggacctagtccaggtggtacgtaccgagggccaaagggacggaacggaggtacgtaggtaaccttaagtttaattcggtacaaacttacaaacgtacgaaaccaccgtagttacggttaaccttagttcgttacgtttaccggaaacgttacggaccgtaaccgtaaacggttacccgaacccgtttccggtacgggttaccaaccggaacccgtaaaaccggacccccaaaaccccgtaccgtaccggttaccaccgtttaaccccg

SEQ ID NO: 416847 - DNA, 582 bp, Homo sapiens
  misc_feature: GZ8MTXP02JZ144.51.35.D02.1.454.CMB.2.raw
  modified_base (240)..(240): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgntatgtcttattggtaccagcagaacgccggccaggccctgtgtgtgatgtataaagacactgagcggccctacgagggtactcccgtgacgcgtattccctcgtggctccgaggtccgaagggacaaaccgggtcaacgtattcgggaccctagtcgaagtggacgtcccgagggcaggaggacgaggctagacttattattgtacaatcaaacagaccacgagtttgtacttatcgttctacgaactcgacgaaccgaacggtacccaccggttccgtcgggtaacctaccggaacccgtaaacggcccctaaaccccagttccggtaccaccctttcccg

SEQ ID NO: 416848 - DNA, 690 bp, Homo sapiens
  misc_feature: GZ8MTXP02FPN84.51.35.D02.1.454.CMB.2.raw
  modified_base (297)..(297): a, c, t, g, unknown or other
  modified_base (663)..(663): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctcgtggagatgcattgaccaaaccgatatgtacttattggtaccagcaggaacgccgggaccacggtcccctggtcgttggngatgtaaataaagacacgtagagacgccctcgaggggactcccgtgagccgtattccgtcgtcggccttaccgaggtacggaacggggaccgtaaacggtcaacgtacgttcgggacctagccgtagtcgggaacgtccgaaacggcgaaagggaacggacggaggtacgtacgaatttaatttcgttagtaaacctaacttaccaaaacgaggtaaacctaaccggtagtttaacggttaactttaagttcggttacgtttacggtaacgtacggtacggaaaccgttaaacgggtccgtaaacccggtttccggtacggggtaccaaccggggaaccccgtaaaccgggaacccaaaacccccngtttaccggaccctaactttcccccgg

SEQ ID NO: 416849 - DNA, 709 bp, Homo sapiens
  misc_feature: GZ8MTXP02G3D1X.51.35.D02.1.454.CMB.2.raw
  modified_base (224)..(224): a, c, t, g, unknown or other
  modified_base (243)..(243): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgctattcgaccaaacgntatgtacttatgtaccagcagaagccggcacggccctgtgtgtgatgtaataagacacgtagagacggccctgacggactcccgtagacgcgtacttcccgtcgtacggcctccgaggtcgaacgggaccgtaaacggtcaacgtagttccggactaacgtacgtacggtggtacgtacccgagggaccgaagggaaacggggaccgggaacgggtacccgttaagggtaacctttaaagtttaacggtttacggttaaaccgaaacgttaacccaaaacgtaacggaaaccctaaccgttaacgtttacgggttaactttacggttacgttacgtttaaccggtaacgtacggtaaccgtaaaccgtaaacggttccgtaaacccggttccgtacggttaaccgaccggaaccccgaaacggaccccctaaacccgtacgttaccgtaccgtaacctttccccgg

SEQ ID NO: 416850 - DNA, 541 bp, Homo sapiens
  misc_feature: GZ8MTXP02I6UPU.51.35.D02.1.454.CMB.2.raw
  modified_base (238)..(238): a, c, t, g, unknown or other
  modified_base (280)..(280): a, c, t, g, unknown or other
  modified_base (357)..(357): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaacgntatgcttatggtacagcagaagccggccagccctgtgtggtnatgtataaagacactgagaggccctgagggactccctgacgcgtattcctgtggctcgaggtcgagggacaacggtnacagttgacatcagtgagtcgagcagaggacgaggctgactattatgtacaatcaaacagaacacctagttaggtacttagtgtacttacggaaactgaccgaacgtaaacggtccaaccgtccgtacgggtacaacgaaccccgaaaggaccccaaaaccccgtgtacgttacaactttcccg

SEQ ID NO: 416851 - DNA, 771 bp, Homo sapiens
  misc_feature: GZ8MTXP02GG35Y.51.35.D02.1.454.CMB.2.raw
  modified_base (305)..(305): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcactgctcgtggagatgctagttcgacccaaacgattaatgtcttagttcggaccagcgaagaacgccgggaccacgccctgtgtgagtatagtaanaaagacacgtgacggacgccgtacgaggctccgagagtcgtacttccgtcgcgtcgtaccgacggttacgacgggaacgtacgggtcaacgtacgttaccggacctagttccgaaaggtcggtaacggacccgaagggaaccgaaaggggtaacggacggtaacgggtacctaacgggtaactttaagtttaacgttaggtaaaaccttaaactaacggtaaaaccaaaccgggttaaaccaaacccgttttaaaacgttggggttttaaaacccgtttacgtttaaccgggttaaccgttaacggtaaaccgttaccgggtaaaccccggttaaaaccggttaaacccgggttaacccggttacccggttaccgggttaccggaacccggaacccggtaaaccccgaaacccggtaacccctaaccccgtacccggttaccgtaaccccgttacccggtttcccg

SEQ ID NO: 416852 - DNA, 601 bp, Homo sapiens
  misc_feature: GZ8MTXP02HQNE1.51.35.D02.1.454.CMB.2.raw
  modified_base (226)..(226): a, c, t, g, unknown or other
  modified_base (261)..(261): a, c, t, g, unknown or other
  modified_base (288)..(288): a, c, t, g, unknown or other
  modified_base (296)..(296): a, c, t, g, unknown or other
  modified_base (305)..(305): a, c, t, g, unknown or other
  modified_base (316)..(316): a, c, t, g, unknown or other
  modified_base (328)..(328): a, c, t, g, unknown or other
tcagcgatcgtatacacgaccggtgctcgatttagcacacgatagttgggtttgggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagacggaccaggatcacctgctcgtgganatgacattcgaccaaacgatatgtcttattggacngcagagccggcacggccctgtgttgtnatagtaanaaggcacgngagacggtccngacggtctccgngacgtcgtattccccgtcgcgcctcgaggttccgaagggaccgacgtacacgacgttcgaccatcggaggtcggtacgtaccgagggacgaaggggttacggaaccggtaggtagtacgtaagttatttacgtaggttacctaagtacaaacagaccgtactaacgttgttaactttagtcgtcgttaacggctacgacgacgtacgtaccgtaccgtcgtacggtccaccgaacccgaacggaccctacccacgtacgtcctaacgttcccc

SEQ ID NO: 416853 - DNA, 641 bp, Homo sapiens
  misc_feature: GZ8MTXP02HHBN6.51.35.D02.1.454.CMB.2.raw
  modified_base (263)..(263): a, c, t, g, unknown or other
  modified_base (282)..(282): a, c, t, g, unknown or other
  modified_base (285)..(285): a, c, t, g, unknown or other
  modified_base (319)..(319): a, c, t, g, unknown or other
tcagcgatcgtatacacgaccggtgctcgatttagcacacgatagttgggtttgggggtgggtccaggaggcagaactctgggtgtctcaccatggcctggatccctctacttctcccccctcctcactctctgcacaggctctgaggcctcctatgagctgacacagccaccctcggtgtcagtgtccccaggacagacggccaggatcacctgctctggagatgcattgaccaaacgatatgtcttattgtaccagcaganccggcaggccctgtgtgtnatnataagacactgagacgccctgaaggtactcccgngacgcgtattccgtcgtggacttccgacggctaacggggcctaaaccggggtcaccgtagttcgggaccacttcgaggtggtaacggtcccaggggcctaagggagggaccgaaggggcccttaaggaccttatttacgttacgttactaaacgttaccaaacgtagaaaccgtaaccctagttacggttaactttatgttaccgttacgggaaacttacggacgttaaacccgacggttccgtacccgtccgttacggggtcccaacggtaacccccgaacgaccccctaaaaccgacccgtacgtaccctaactttcccg

SEQ ID NO: 416854 - DNA, 587 bp, Homo sapiens
  misc_feature: GZ8MTXP02I1DGP.51.35.D02.1.454.CMB.2.raw
  modified_base (241)..(241): a, c, t, g, unknown or other
  modified_base (287)..(287): a, c, t, g, unknown or other
  modified_base (289)..(289): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaccgntatgtcttatggtaccagcagaacgccggccacggcccctgtgtgngntgtataaagacactgagacgcctacgagggactccctagacgacggtatttcccgtcgtggctaccgacggtcgaacgggtaccaacggtcaacgtacgttcggacctagtaccgtaggtggacgtaccgaggaccaagggaggacgaggtctacgattaatttagtgtaacaataacaaacacggaaccaacgtattcggttaattacgtgttcttacggaacttcgacgaccgacgtaccgaaccgttcgtacggtcaaccgaaccgaacgaccctaaccactctaccacttcccg

SEQ ID NO: 416855 - DNA, 627 bp, Homo sapiens
  misc_feature: GZ8MTXP02HCNHV.51.35.D02.1.454.CMB.2.raw
  modified_base (259)..(259): a, c, t, g, unknown or other
  modified_base (288)..(288): a, c, t, g, unknown or other
tcagcgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctggtgtcaggtgtccccaggacagacggccaggactcacctgctcgtggagatgcattcgccaaacgatatgtacttatggtaccngacagaacgccgggcacggccctgtgtgngatagtataagacatagagacggcctagaggtactcccgtaggacgcgtattccctgtcgtctccgaggttcgaaggggacctaaaccgggtcacgtagtcggaccatcgaggtcggaatccgaggcaaggtaggaccggtagacagtactattagttataagaactacgaacgacgaacccaagttagtacggttaactttagtaccgtacgtttaaacggtacgttacgaacccgtaccgttaaacgggtacctaacccggttccggtacgggttaccaccgggtaaccccaaaggacccccgtaaacccctacgtccggtacctaaccgttacccg

SEQ ID NO: 416856 - DNA, 525 bp, Homo sapiens
  misc_feature: GZ8MTXP01D34QS.10.6.A06.1.454.CMB.2.raw
  modified_base (262)..(262): a, c, t, g, unknown or other
  modified_base (427)..(427): a, c, t, g, unknown or other
  modified_base (440)..(440): a, c, t, g, unknown or other
tcagcatagtagtgcacgaccggtgctcgatttagatctactgacaacacacgaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcnggtaccaacaacaccagcaaacgccccaaatcaataatcatgatgtacaataatccgcctcgtaggggtttctaatccgcttactctggtcttacaagtctggcaacaccggcctcctgaccatctctggctcagctgagcgagctagattatacgtgcagctanatactaacaaccngcaagctacggtgggtcggttcgggacggaagggacctaagcgttcgaccgtccgtagcacgccgaaggtcccgttcgtcccccg

SEQ ID NO: 416857 - DNA, 622 bp, Homo sapiens
  misc_feature: GZ8MTXP01C2BU8.10.6.A06.1.454.CMB.2.raw
  modified_base (231)..(231): a, c, t, g, unknown or other
  modified_base (262)..(262): a, c, t, g, unknown or other
tcagcatagtagtgcacgaccggtgctcgatttagatctactgacaacacacgaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtgaaccngcagtgacgttggtagttatactatgtctcngtacaacacaccagacaacgcccaatcataatcatgatgtacaattaactccggacccttcggtacggggtttctaacgtcccgtctttacgtcgtcggtcttaacgtaagttcgtcggaccaaaccgtacccggtccctcccgtacgaccctacttcctcgtcgtcgccttcccgaaggtccgtaggaacgggtacggacggtcgttagtaactttactttacgtcggtacacgtactaccaattaactaaaccaacctagacacgcgtaacgtcgggttaggtcgggcgggtaacggaccaacggttcttacggtaaccgtacgtaacggtccgacgttaccgaacggccgtccccgg

SEQ ID NO: 416858 - DNA, 591 bp, Homo sapiens
  misc_feature: GZ8MTXP01CV4S6.10.6.A06.1.454.CMB.2.raw
  modified_base (275)..(275): a, c, t, g, unknown or other
  modified_base (278)..(278): a, c, t, g, unknown or other
  modified_base (317)..(317): a, c, t, g, unknown or other
  modified_base (333)..(333): a, c, t, g, unknown or other
  modified_base (464)..(464): a, c, t, g, unknown or other
  modified_base (470)..(470): a, c, t, g, unknown or other
tcagcatagtagtgcacgaccggtgctcgattttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctgggtggaggtcgtggggggaggccgtgggtcgaacgggccgggggggtctcgtgagactgtctgtgtgcctctgcttcctctnagntcagcatgactcggccgcgaggctcgagggaggcgtggnggtgggtcgacaaccntcagcagttcttacccctagtttacattactacgtaacgacaagtatcgtgtaggaacgggccgtctcaccacttccaccagacgaacgaccgaccgacgactacagtgtcggctaggacaaatcgaaacncgccgngggaccgacggaacggtacgacggacgtaagaattacgttaacgtggacggtacgaaggttacgttacgtttacgggtggttacggtaagtaacgtaacgttacggaacgttaagttaacg

SEQ ID NO: 416859 - DNA, 590 bp, Homo sapiens
  misc_feature: GZ8MTXP01EV0QX.10.6.A06.1.454.CMB.2.raw
  modified_base (252)..(252): a, c, t, g, unknown or other
  modified_base (259)..(259): a, c, t, g, unknown or other
  modified_base (299)..(299): a, c, t, g, unknown or other
  modified_base (302)..(302): a, c, t, g, unknown or other
  modified_base (335)..(335): a, c, t, g, unknown or other
  modified_base (458)..(458): a, c, t, g, unknown or other
tcagcatagtagtgcacgaccggtgctcgatttagatctactgacaacacacgaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggacagcagtgacgttggtgttatactntgtctcngtacaacacaccagacaacgccccaatcataatcatgatntanaatactccgcctgtagggttactatcccgcttntcgtggtccttaacgaagtctacgggaccaaccgaccgtccctcctacgaccctactctcgtcgggctccgaggacgtaggacggacgagggtctagtacttattacggtgactacgtactanactaactaacaaccgagacgtacgacgtacggtcgggtcggttacggggacgggacgggacctaacggccgttcggaccccgttcggtacggtccgaccggcccgttaacggtcccgttcccgtccccccgg

SEQ ID NO: 416860 - DNA, 637 bp, Homo sapiens
  misc_feature: GZ8MTXP02JZJ8E.10.6.A06.1.454.CMB.2.raw
  modified_base (589)..(589): a, c, t, g, unknown or other
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtggtcgaaggccgggggggtctcgtggagactgtcctgtgttgcctctggacttccctctcgaggtagtttcagcatgaacgtcggggtcccgccgaggcctccgaggggacgggccgtgggaggtcggggtccgacaaaccatcgagactagttacttacccagttacatatactacgacagaatcgtaggtagaagggcccgtcttaccaccctatccctaccgaagacgaaccgaccgaccgaacggaaactcaaagtcggtacggctagactaaagtcggaaacacggccgtaggggaaccgccggaacggacgacgggacaaaaggtattaacgttacgaggtacgacgaaggtacgttacgtttaaaggngggttaccggtagtaaacgttaacgtacggaaaaccgtactttaacgg

SEQ ID NO: 416861 - DNA, 576 bp, Homo sapiens
  misc_feature: GZ8MTXP02JJ7U4.10.6.A06.1.454.CMB.2.raw
  modified_base (257)..(257): a, c, t, g, unknown or other
  modified_base (267)..(267): a, c, t, g, unknown or other
  modified_base (273)..(273): a, c, t, g, unknown or other
  modified_base (335)..(335): a, c, t, g, unknown or other
  modified_base (375)..(375): a, c, t, g, unknown or other
  modified_base (410)..(410): a, c, t, g, unknown or other
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggcctgggtcaaggccgggggggtctctgagactgtcctgtgttgcctntgcttccctntcaggnttcagcatgaactcgggtccgccaggctccgaagggacggcctggagtgggtcgacaaaccngtcagctagtacttccccagttacatatactacgcagatntgtagaggcgcttacaccatcctcagacgacgacncccgaaggacctacaagtgtagctagactaaagtgaaaccgacgccgtaggggaacgacccggaaggaccacgggacaaaggtactaacgttacgacggtgacggaagtacgttacgtttaagtgggtacggttagaaacgtaacgttacggaaaaccgcttaacg

SEQ ID NO: 416862 - DNA, 574 bp, Homo sapiens
  misc_feature: GZ8MTXP02FRK4U.10.6.A06.1.454.CMB.2.raw
  modified_base (301)..(301): a, c, t, g, unknown or other
  modified_base (340)..(340): a, c, t, g, unknown or other
  modified_base (393)..(393): a, c, t, g, unknown or other
  modified_base (406)..(406): a, c, t, g, unknown or other
  modified_base (418)..(418): a, c, t, g, unknown or other
  modified_base (426)..(426): a, c, t, g, unknown or other
  modified_base (432)..(432): a, c, t, g, unknown or other
tcagcatagtagtgcacgaccggtgctcgatttagatctactgacagggggagagaggagccttagccctggattccaaggcctatccacttggtgatcagcacggagcaccgacgattcaccatggaactggggctccgctgggttttccttgtcgctattctagaaggtgtcctgtgtgaggtgcagctggtggagtcgtgggggaggccgtggtcgaaggccgggggggtctcgtgagactgtcctgtgttgcctctggactttccctctcaggtagtttcagcatgaactgggtccnccaggctccgagggacggcctggagtgggtcgacaaccntcagcagttacttcccagttacattactactacgcagatctggtagaagggcncttcacctatccncagacgacgacncgaagacnaagtgngctgacaatagaacagaccgtgggacaccggaggaccgacggacaagtaactagttaacgtcgtaggacgtagtaacgtacgttttaaaggtcggggttcggtaaggtaaacgtaacgttacggggaacgtaactttaacgg

SEQ ID NO: 416863 - DNA, 642 bp, Homo sapiens
  misc_feature: GZ8MTXP02JELFK.10.6.A06.1.454.CMB.2.raw
  modified_base (254)..(254): a, c, t, g, unknown or other
  modified_base (265)..(265): a, c, t, g, unknown or other
  modified_base (293)..(293): a, c, t, g, unknown or other
  modified_base (313)..(313): a, c, t, g, unknown or other
  modified_base (330)..(330): a, c, t, g, unknown or other
tcagcatagtagtgcacgaccggtgctcgatttagatctactgacagggggagagaggagccttagccctggattccaaggcctatccacttggtgatcagcacggagcaccgacgattcaccatggaactggggctccgctgggttttcctgtcgctattctagaaggtgtcctgtgtgaggtgcagctggtggagtcgtgggggagcctggtcaaggccggggggtctcgtgagactgtcctgtgttgcctntggattccctntcaggatttcagcatgaacgtgggtccncaggctccgagggacggcgnggaggtgggtcgcaacntcagtcagtattccccagttacatatactacgcagatctgtacgaacgggccgcttcgaccatcctacccgagacgtaacgaccgaccaggaactacaacgttgtacgggccttaggacctaaaatcgggaaacctacggtacccgttagggggaccgacccggaaggggaaccaacgggggtaccaaaagggtaccttaaagttaccgttagggacggtaccggtaacgtaacggttccgtttaaaaggtcggggttaaccggtaggtaaacgttaaacccggaggggtaaaaccgtacgtttaaaccggg

SEQ ID NO: 416864 - DNA, 665 bp, Homo sapiens
  misc_feature: GZ8MTXP01EOY5X.52.26.C04.1.454.CMB.2.raw
  modified_base (219)..(219): a, c, t, g, unknown or other
  modified_base (302)..(302): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctntggagatgaattggggaaataaatttgcttgctggtatcaccagaacgccaggccagtcccctgtcctggtcatctatcaagntgtcaagccgcctgagggacctcccgtagacgcgtacttcctcgtgggcctacccgaaacttcgacggggaaccacgacgccctaacttccgacgaacccacgtccgaaacggccccgggggaacccaggggacccttaaagggtcgggtaagtacgggacggggttacgttaacggtaaccgtttaacgttaacgtcggtaaccggtacggggtaccgggtacgggaactaacggaaccgtaaaccgtaacggttcgggttagggttacgggttacggggacgggaacgggaaccgacggttccggtaaccggtacccggttaacggtacggtaccgaccggtaacccgttaacgggtcccg

SEQ ID NO: 416865 - DNA, 529 bp, Homo sapiens
  misc_feature: GZ8MTXP01A7LIV.52.26.C04.1.454.CMB.2.raw
  modified_base (259)..(259): a, c, t, g, unknown or other
  modified_base (482)..(482): a, c, t, g, unknown or other
  modified_base (501)..(501): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctgtgcctcatcagcgtcatgttactctgggctgganccgccagcccccagggagggctggagtggattggaatagtctattatagtggagcacctcctactacaacccgtcctcaggagtcgagtcaactataatccgtagacacgtccaagacctagttctccctgaagctgagctcgtgtcgacccgcgcagaccacggggtcttgtttattactgtgcgagacatcctaagcaaataatgttaggattacgattanggttattgctagtttccgnggggaccagggtaacccttgggtaaccc

SEQ ID NO: 416866 - DNA, 557 bp, Homo sapiens
  misc_feature: GZ8MTXP01ESH9Z.52.26.C04.1.454.CMB.2.raw
  modified_base (228)..(228): a, c, t, g, unknown or other
  modified_base (252)..(252): a, c, t, g, unknown or other
  modified_base (444)..(444): a, c, t, g, unknown or other
  modified_base (519)..(519): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtncctcatcagcgtcatggtacttcnggggctggactcccgccacgcccccgaaggggaacgggctggagtggattggaaatatctattataggtggagctacctctacaccaacccgtccctcaggagtcgagtcaacttataactccgtaagaccacgtacccaaagaccctagttccctacccgtagaacgctagagtctctcgtcgaccgccgnacgaccacggggcttaggtttaacttactgttcgcgtaagacatacctaagcaaataatgttaggattacattanggttattgctagtccgtgggcacgggaaccttggtccc

SEQ ID NO: 416867 - DNA, 595 bp, Homo sapiens
  misc_feature: GZ8MTXP01DHFLV.52.26.C04.1.454.CMB.2.raw
  modified_base (311)..(311): a, c, t, g, unknown or other
  modified_base (367)..(367): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaacgccttcggagacccctgtcccctcaccctgcactgtctctggtcgcctccatcagcggtcattggttacttcgtgggctggatcccgcacgccccgagggagggctggagtggattggaaatntactattatagtggagcacctctactaccaccgtcctcaggagtcgatcaactatntccgtagacacgtccaagaccagttctcctagaacgctagagcttacgtgtcgaacccgcgacgacgaccacgggggtctttaggtttacttacgtgtcgcgaagaacctataacctaagacctaaagttaatggttagaattaaacgtactttaagttacggttagtttcggaacttacgttcccggttcgggtacccgttacgggtaaccccgttgggttaacccc

SEQ ID NO: 416868 - DNA, 633 bp, Homo sapiens
  misc_feature: GZ8MTXP01C8FN8.52.26.C04.1.454.CMB.2.raw
  modified_base (197)..(197): a, c, t, g, unknown or other
  modified_base (230)..(230): a, c, t, g, unknown or other
  modified_base (263)..(263): a, c, t, g, unknown or other
  modified_base (273)..(273): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctccagatgggtcctgtcccagctgcagctgcaggagtcgggcccaggcctaggtaaagccttcgganaccctgtcccctcacctgcactgtctctggtcncctcatcgagtcgtctagttcggttacgtcggngggctcggcncccgccgaccgcccggagggaggcgtggagtagtagtagaatatactaattagtaggtggacacctacctacctaactaacctaccccgtcctacgaggtacgtcgactactaaacttataacgtaccgtaacaaccgtaccgtaaccaaacgtaacctacgttaccctaccgtagaacgtcgtagacgtctcgtcgacgacccgcgacgagtaccgacggggttctttagtttactacgtgtacgacgtagtaactattactaaacgtaactaaataagtagttagtacttacgtaacgttagttagttgttcgtcgtacgttccggtcgggtaccggaccggtaaccgttcgtaaccg

SEQ ID NO: 416869 - DNA, 566 bp, Homo sapiens
  misc_feature: GZ8MTXP01B8H32.52.26.C04.1.454.CMB.2.raw
  modified_base (230)..(230): a, c, t, g, unknown or other
  modified_base (311)..(311): a, c, t, g, unknown or other
  modified_base (371)..(371): a, c, t, g, unknown or other
  modified_base (377)..(377): a, c, t, g, unknown or other
  modified_base (511)..(511): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtcncctcatcagcggtcagttggttacttcgtggggctggatccgccacgcccccgagggaagggctggagtggattggaaatntctattatagtggagcacctcctactaccaacccgtccctcaggagtcgagtcaactatntcgtanacacgtaccaaagaaccacgttctccctgaacgctgagctctgtcgaccgcgcagtaccacggggtcttagtttactacgtgtagcgagaaccatacctaaagactaataaagtgttaggattacgtattaagnggttagtttcgctattccgtacggggcccgttacggggtaacccttgggtaaccc

SEQ ID NO: 416870 - DNA, 604 bp, Homo sapiens
  misc_feature: GZ8MTXP01EAA45.52.26.C04.1.454.CMB.2.raw
  modified_base (268)..(268): a, c, t, g, unknown or other
  modified_base (352)..(352): a, c, t, g, unknown or other
  modified_base (436)..(436): a, c, t, g, unknown or other
  modified_base (512)..(512): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtcgtccgtcgtccccaggacagacagccagcatccacctgctgtggagtagtagaagttaggggtaaattaagtttgcttgctggtacncaaccgagaacgccgacggcctacgtcccctgtcctgtcattctatacaagactgtacgaacgccgcctagacggtccctccgngacgtctacttctccgtgaccctaccaacgtcgtacgggaacacgactcctactcgtacgactagcccgaagggcccggaaccnggtacaggtgaacgtggacggggtctacggtacttaagtcgtggtacgcgggtcggtacggacacgactaacggtntcggggttaggtccggttacggggacgggaacgttacccgaggttccgtaacgtacccggttcgacgggcccacgtcccggaacgttccccg

SEQ ID NO: 416871 - DNA, 576 bp, Homo sapiens
  misc_feature: GZ8MTXP01E06W0.52.26.C04.1.454.CMB.2.raw
  modified_base (424)..(424): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccaggcatcacctgctctggagatgaagttaggggaaataaattgcttgctggtatcaccagaagccgaggccacgtcccctgtcctggtcatctatcaagatgtcagccgccctcgagggacctcccgtgacgcgtacttcctcgtggcctcccaaacgtcgtaggggaacacacgccctactcgtacgaccatccgacggccggggacccagggctagnggaagtggaggggtctaggacttagttacgtggtacgagggtcggtaggggacacggaccaaacgtcgttggttagggtacgttcggggacggggaacgggaccgaggccgtaacgacccgtccgtaggccgaccgtcccgaagggtccccg

SEQ ID NO: 416872 - DNA, 552 bp, Homo sapiens
  misc_feature: GZ8MTXP01C570P.52.26.C04.1.454.CMB.2.raw
  modified_base (430)..(430): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaagttggggaaataaagtttgcttgctggtatcaccagaagccaggccacgtcccctgtcctggtcatctatcaagatgtacaacgccggccctcgacggggacctccccgtgacgtcgtatttcctctcgggcctacccgaactcgtacgggaacacgacgcccactctacgaccatccgaggcccgggacccagggctagnggatcggaggggtctagacttagttactgtcgaggcgtagggacagcaaacgtcgtgggttaggtagttccgggacgggacgggaccaggctcggacctcgtaggcacgcccgaaggtcccg

SEQ ID NO: 416873 - DNA, 562 bp, Homo sapiens
  misc_feature: GZ8MTXP01AHVUU.52.26.C04.1.454.CMB.2.raw
  modified_base (393)..(393): a, c, t, g, unknown or other
  modified_base (401)..(401): a, c, t, g, unknown or other
tcagcgcagtacgacacgaccggtgctcgatttagtctagcgactttgggtttggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtgcctccatcagcggtcatggttacttctggggctggatccgccagccccccgagggaagggctggagtggattggaaatatctattatagtgggagcacctcctactacaacccgtcctcaggagtcgagtcaactatctccgtagacacgtccaagaccagttcnccctgaanctgacgctcctgtcgacccgccgcacgacgacgggggtcttaggttttactaccgttgtgccgagacctagtcctaaagcaaataaatggttagattacctagttaattgggttagttgctattcccggtcggggaccacggggtaacccttgggtaaccc

SEQ ID NO: 416874 - DNA, 694 bp, Homo sapiens
  misc_feature: GZ8MTXP01BC37I.52.26.C04.1.454.CMB.2.raw
  modified_base (229)..(229): a, c, t, g, unknown or other
  modified_base (332)..(332): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtcncctcatcagcgtcattggttacttcgtggggctggactcccgccgacgcccccgaggggaaggggctgggagtggattaggaaatatctattagtaggtgganctaccgtcctactaccaacccgtcctacgaggtagtcgacgtcaaacttatcgtccgtagaccacgtaccgaaacgaacctacgttccctccgtagaacgtcgtagagtccgttcgtcggtcgaaccccggccgacaacggtaacccgtacggggggttcctttaggggtttttaaacttaccggtggttacggaccgtaaaggtaacccgtaattaacccgtaaaagtcctaaaagttaaagttggttaaagggtaacttaaaccgtaacgttttaagttcgggttaagtttcggtaacctaacgttttccgggtacgggggtaccccaacggggggtaaccccctttggggtaaccccgg

SEQ ID NO: 416875 - DNA, 568 bp, Homo sapiens
  misc_feature: GZ8MTXP01DMYXP.52.26.C04.1.454.CMB.2.raw
  modified_base (304)..(304): a, c, t, g, unknown or other
  modified_base (435)..(435): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaaattgggggaaataaattgcttgctggtatcaccagaagccaggcccagtcccctgtcctggtcatctatcaagtntgtcaagccgtccctcgacgggacctccccgtgacgtccgtatttccgtcgtcggccctaccgaaaccgttcgtacggggaaaccacgacgccctacttcacgaccatccgaggccgggaccaggcttagnggatggaggtctagacttaagttcgtgtcgaggtcgtgggacaggcaaactgtggttaggtacgttcggggacggtacgggaacccgagccgttaacggacccgttcgacggtccacgtcccgaaggtccccg

SEQ ID NO: 416876 - DNA, 780 bp, Homo sapiens
  misc_feature: GZ8MTXP01BQ659.52.26.C04.1.454.CMB.2.raw
  modified_base (300)..(300): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaattgcttgctggatcaccagaacgccaggccacgtcccctgtcctggtcatctatcaagntgtcaagccgccctcgacgggtaccctccccgtggacgtccgtacttccgtcgtcgggacctacccgaaaccttccgtacggggaaaccacaacgcccctaacgttccgtacggaacccctaagttcccggaaaccggggaccccggggaaccccaggggtaccttaaagggtggggaaacttgggggaaacgggggtcctttacggggtaaacccgtttatttttaaccccggggtacgggttacccgggaacgggggttacccggggtaacgggggaaacccgtaacggtaacccgtaaaaccgggttaacgggtttcgggggtttaacggggttaacccggggttaccggggggaaacccgggggtaaacccgggggttaacccgttaaaccggggttcccgttaacccgggtaccccggtttaacccggtaacggggtaccccgaacccgggtaaccccggaaacggggtcccccg

SEQ ID NO: 416877 - DNA, 551 bp, Homo sapiens
  misc_feature: GZ8MTXP01C00RR.52.26.C04.1.454.CMB.2.raw
  modified_base (230)..(230): a, c, t, g, unknown or other
  modified_base (319)..(319): a, c, t, g, unknown or other
  modified_base (455)..(455): a, c, t, g, unknown or other
  modified_base (500)..(500): a, c, t, g, unknown or other
  modified_base (508)..(508): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcggcccaggcctggtaaagccttcggacgaccctgtcccctcacctgcactgtctctggtcncctccatcagcgtcattggtacttcgtggggctggactccgccacgcccccgagggaacgggctggagtggattggaaatatctattangtggagcactcactacaccgtcctcaggagtcgacgtcaaactataactcgtagaccacgtaccaagaaccagttcaccctagaacgctgacgcgtcctgtcgaccgccgcagacacgggtctgtttactacttgngacgtagaaccatctaagcaaagtaaatgttaggacttatacgtnttaggttnttggctagttcccgtggggccgaggtaacccgttggttaaccc

SEQ ID NO: 416878 - DNA, 646 bp, Homo sapiens
  misc_feature: GZ8MTXP01AM8OR.52.26.C04.1.454.CMB.2.raw
  modified_base (230)..(230): a, c, t, g, unknown or other
  modified_base (313)..(313): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggacgaccctgtccctcacctgcactgtctctggtcncctccatcagcgtcattggttacttcgtggggctggactccgccacggcccccgaggggaagggctggagtggattggaaatntctattataggtggagccaccgtacctactaaccaaccccgtcctacgacggtagtcgacgtcaactatctccgtagacacgtaccaacgaacctgttcctcctaggaacgctgactctcgttggacgcccgccgacacgaccgacggggtctttaggttttactaccgttggtcgcggtaacgactaataccgtaaagaaccttaaagttaagttggttaggaacttaaacccgttaacttttaggttaggggttcgttacgtaaccgttaaccggtttcccgggtacgggggaccccgttaacgggggtaacccccgttggggtttccccc

SEQ ID NO: 416879 - DNA, 710 bp, Homo sapiens
  misc_feature: GZ8MTXP01ECHWQ.52.26.C04.1.454.CMB.2.raw
  modified_base (312)..(312): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtcgtccccaggacagacagccagcatcacctgctcgtggagataggaagttaggggtaaattaaagtttgcttgctggatcacagaacgccgacggccacgtcccctgtcctggtcatctatcaagntgtacaaggccggccctacgacgggtaccctccccgtagacgtcgtacttccctcgtcggtaccctacccgaaaccgttaccgtacggggaaaccaccgaccggtacccctaacgttcccaacggaacccctacgttacccggaaccggggtaccccgggggaaacccctagggggacctttaggacggggtaaagtcgggtaaacgggggtcttaacggtaaacctttaacgttaccgtggttaccggaagggtccggtacggggaaacctaggaaccaaacgtcggttagggttacgggttaacgttcgggggaacgggaacgggacccgaaggttcccgttaacggaccccgttccggtaacgggcccaccggtaacccccgttaaggggtcccc

SEQ ID NO: 416880 - DNA, 634 bp, Homo sapiens
  misc_feature: GZ8MTXP01CU4UE.52.26.C04.1.454.CMB.2.raw
  modified_base (229)..(229): a, c, t, g, unknown or other
  modified_base (242)..(242): a, c, t, g, unknown or other
  modified_base (265)..(265): a, c, t, g, unknown or other
  modified_base (322)..(322): a, c, t, g, unknown or other
  modified_base (523)..(523): a, c, t, g, unknown or other
  modified_base (537)..(537): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtcncctcatcagcgtnagttgttacttcgtgggctgacnccgcgacgccccgagggacgggctggagtggataggaatatctattagtaggtgganctacctcctaactaccacccgtcctacgaggtacgtcgtacgtctaaacttataacgtaccgtaacgaaccgtaccgtaaccaaacgtaaaccgtacgttacccttacccgtagaacgtcttaggaacgtcttccgtaggtaccgaccgccgacaacggaccgtacggggtctttaggttttaactacgtgtcgacgtaanactactacgtaaanactaagttaagtgttagtacttacgttaagttggttagttcgttcgtaacgttacggtcggacgggtaccgttaccgggttaaccgttcgtaacccg

SEQ ID NO: 416881 - DNA, 662 bp, Homo sapiens
  misc_feature: GZ8MTXP01EY8YW.52.26.C04.1.454.CMB.2.raw
  modified_base (224)..(224): a, c, t, g, unknown or other
  modified_base (300)..(300): a, c, t, g, unknown or other
  modified_base (305)..(305): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctgganagtagaagttaggggaattaagttgcttgctgatcacagaacgccacggcctacgtcccctgtcctggtcatctancaagntgtacgagccgcctacgacggtacctcccgtagacgtaccgtacttcttccgtcgtaccctcctaaacgtcgtacgggaaccacgacgaccctacttacgacgaccctagtaccgaccgggaccggggtacccagggtaccttaggacgaagttccgggaaggtcgttaacggaacttacgtttaacgtcggtaaccgggtcgggtaccggtacgggaacctacgaaccgtaacgtaacggttcgggttacgggtaacgggttcggggaacgggtaaacgggttaaccgacggttcccggtaaccggtacccggtaaccgtaacggacccgaccggtaaccccgttaacggtccccg

SEQ ID NO: 416882 - DNA, 691 bp, Homo sapiens
  misc_feature: GZ8MTXP01ENOBT.52.26.C04.1.454.CMB.2.raw
  modified_base (478)..(478): a, c, t, g, unknown or other
  modified_base (488)..(488): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtcgtccgtcgtccccaggacagacagccagcactcacctgcctgtaggagtagtagtaaggttaggggtaaattaagttcgtacttgcgtaggtatccaacgagaacgccgaacggtccccgtaccgttcccccgtgttccccgtggtactacttctaactaccgaaggtattcgtacgaacggcccgtcccgtacggacgggtaccctcccgtgacgtcgtacttcctcgtcgtcctaccactcgtacggaacactacgcctacgctaacgaccagtccgaacgggtcccggtaaccngggtcttagngggtatagggacgggtcttacgtaacgtttacgttaccgtggtacgtacggggtacggttaacggaacgttacggtaaaaccggtggttaaggggttaacggtttacggggtccgggaaacgggacgggttaaccgaaggttccgttacccgtaaccggtcgtaacggacgaccgttaccgggtaaccgttccgttcccccgg

SEQ ID NO: 416883 - DNA, 568 bp, Homo sapiens
  misc_feature: GZ8MTXP02FYP3Y.52.26.C04.1.454.CMB.2.raw
  modified_base (405)..(405): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctccatcagcggtcattggttacttcgtggggctggactccgccacgcccccgaggggaacgggctggagtggataggaaatatctattataggtggagcacctctactaccaaccccgtcctccaggactcgagtcacttatctccgtagacaccgtccaaagacctagtttccnccctagaacgctgagtctcgtgtcgacccgcgacagaccacgtcttagtttactacgtgtcgacgtagactatactaaagctaaaatacgtggtagacttactacgtttagtaggtacgttgaactacgttccgacggggccctacgggaaccctcggtaccc

SEQ ID NO: 416884 - DNA, 555 bp, Homo sapiens
  misc_feature: GZ8MTXP02FGAE6.52.26.C04.1.454.CMB.2.raw
  modified_base (328)..(328): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtcgcctccatcagcggtcatggttactcgtggggctggatccgccacgcccccgaggggaaggggctggagtggattggaaatatctattataggtgggancacctcctactacaaccccgtcctccgaggagtcgagtcactatctccgtagacacgtaccaaagaaccagttcctccctagaacgctgagtctcgtgtcgaccgccgcacgacacggtcttgtttattacgtgtgcgagacatactaaagcaaaataatgtaggaatactacgttagtggagtttgctagttccgcgggggaccaacggggaacccctggtacccc

SEQ ID NO: 416885 - DNA, 547 bp, Homo sapiens
  misc_feature: GZ8MTXP02H24JS.52.26.C04.1.454.CMB.2.raw
  modified_base (303)..(303): a, c, t, g, unknown or other
tcagcgcagtacgacacgaccggtgctcgatttagtctagcgactttgggtttggggctgggcctcaggaagcagcatcggaggtgcctcagccatggcatggatcccctctcttcctcggcgtccttgcttactgcacaggatccgtggcctcctatgagctgactcagccacactcagtgtccgtgtccccaggacagacagccagcatcacctgctctggagatgaattggggaattaaatttgcttgctggtatcaccagaagccaggccacgtcccctgtcctggtcatctatcaagntgtcaagccggccctcgacgggacctccccgtgacgcgtattccgctggcctaccaaacgtcgtacggggaacacgacgacccactcctacgaccctatccgacggccggggacccagggcctagtggatcgagctgacttatactgtcaggcggtggacagacactacgtggtggtactcgggacggacggaaccagtacgtcgtaacccgtcgtacgggtaccacggcccgaacggtccccg

SEQ ID NO: 416886 - DNA, 638 bp, Homo sapiens
  misc_feature: GZ8MTXP02JMAGX.52.26.C04.1.454.CMB.2.raw
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtgcctcatcagcgtcagtggttacttcgtggggctggactccgccacgcccccggagggaacgggctgggagtggtattaggaaatatctaattagtaggtggagccaccttcctaacctaccaaccccgtcctccgaggacgtcgagtcacttatctccgtaacaccgtaccgtaccgaaacgaaccctacgttccctaccctagaacgtcgtgacgtctcgtgtccgacccgccgacacgaccgacggtcttagtttacttacgtgtacgacgagtactacgtaacgtaagactaaaagttacgtagtacggtaactaaccgtaacgtttacgtaggttacgttacgaacgtaaccgtttccggacgggggtaccgtaaccggggtaacccccgttgggttaacccccg

SEQ ID NO: 416887 - DNA, 574 bp, Homo sapiens
  misc_feature: GZ8MTXP02I15BR.52.26.C04.1.454.CMB.2.raw
  modified_base (229)..(229): a, c, t, g, unknown or other
  modified_base (373)..(373): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtnccctccatcagcggtcatggttacttcgtggggctggatcccgccacgcccccgaggggaacggggctggagtggattggaaatatctattagtagtggagcacctcctactaccaacccgtccctcagagtcgagtcactatntccgtagaccacgtccaaagaacctagttcctccctagaagctgagctcgtgtcgaccgccgcagaccacggtcttagtttacttacgttgtcgacgagacaattactaaagctaaaataaagtggtaggtataactactttagtacggtagtttgctacgttccggtacgggggacctaacggggtaccctcggtacccg

SEQ ID NO: 416888 - DNA, 563 bp, Homo sapiens
  misc_feature: GZ8MTXP02IV26N.52.26.C04.1.454.CMB.2.raw
  modified_base (230)..(230): a, c, t, g, unknown or other
  modified_base (324)..(324): a, c, t, g, unknown or other
  modified_base (490)..(490): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaacgccttcggacgaccctgtccctcacctgcactgtctctggtncctcatcagcgtcatggttactctggggctggatccgccacgcccccgagggaacggggctggagtggatggaaatatctattatagtgggacncactcctactaccaacccgtcctacagacgtcgagtcactatatccgtagaccacgtaccaaagaaccagttcctcccgtagaagcctagacgtctcgtcgtcgacccgccgacaagacctacgggtctttgtttacttacgtgtcgcgtagacaattccgtaaanactaagtagtgtagtactactattagtgtagttacgtcgtacgtcggacgggaccgtacggtacctcggtacc

SEQ ID NO: 416889 - DNA, 609 bp, Homo sapiens
  misc_feature: GZ8MTXP02HL36B.52.26.C04.1.454.CMB.2.raw
  modified_base (265)..(265): a, c, t, g, unknown or other
  modified_base (458)..(458): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtcgtccccaggacagacagccagcatcacctgctcgtggagatagaagttaggggaaattaaagtttgacttgctggtancaaccgagaagccaggccacgtccctgtcctgtcatctatacgaagtagtacgtacgaaacggcccggtaccctacgacgggtaccctccccgtagacgtacgtactttccgtcgtcggtccttaccaaaccttcggtacgggaaccacacgcctacgtctacgaccagtccgacggccggacccaggctagngatgaggtctagaccttagtactcgacgacgggtcgagggaacagacgaaaccgtcgttagggttaggtaccgttcgggggaaacggacggtaacaacggtccgtaacgggtacccgtacggtacgaccgacggaccccgttaagcccccg

SEQ ID NO: 416890 - DNA, 620 bp, Homo sapiens
  misc_feature: GZ8MTXP02G89VN.52.26.C04.1.454.CMB.2.raw
  modified_base (224)..(224): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctntggtgcctcatcagcggtcatggttactcgtggggctggactccgccacgcccccgagggaacggggcgtggaggtggataggaaatatctaattagtagtggagcacctcctactaccaacccgtcctcgagacgtcgagtcactatctccgtaagacctacgtaccaaacgaacctacgttccctaccctagaaacgcgtagacgtctcctcggtcgacccgccgacgaacgaccgaacggtcttaggtttacttacgtgtcgacgagtacaattacgaaacgactaaaagtacttagaggtactaaactaaccgtttagtacgggtaagtttcgaacgtacggtttcccggtagggggtaccccgaaacggggtaccccgtcgggttaccccg

SEQ ID NO: 416891 - DNA, 540 bp, Homo sapiens
  misc_feature: GZ8MTXP02IW438.52.26.C04.1.454.CMB.2.raw
  modified_base (228)..(228): a, c, t, g, unknown or other
  modified_base (303)..(303): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtncctcatcagcggtcatgttacttctggggctggatccgccagcccccagggaacgggctggagtggatggaaatntctattataggtggagcacctcctactaccaacccgtcctccagacgtcgagtcactatctccgtagaccaccgtaccaagaaccagttcctccctgaacgctgagctctgtcgaccgccgcagaccacggcttgtttattaccgtgtcgcagtacatactaagctaataaatgagatacgacttagtaggtattgctacgttccgtacggggcctaacgggtaccctcgggtaccc

SEQ ID NO: 416892 - DNA, 575 bp, Homo sapiens
  misc_feature: GZ8MTXP02H61K7.52.26.C04.1.454.CMB.2.raw
  modified_base (311)..(311): a, c, t, g, unknown or other
  modified_base (327)..(327): a, c, t, g, unknown or other
  modified_base (379)..(379): a, c, t, g, unknown or other
  modified_base (405)..(405): a, c, t, g, unknown or other
  modified_base (482)..(482): a, c, t, g, unknown or other
  modified_base (535)..(535): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtcgcctccatcagcggtcatggttactcgtggggctggactccgccacggcccccaggggaacgggctggagtggattggaaatntctattataggtggancacctcctactaccaaccccgtcctcaggacgtcgagtcactatctccgtanaccacgtaccaacgaacctgttcccnccctagaacgctagacgtcttctgtcgacccgcgacgagaccgacggtctttagtttactacgtgtcgacgagtacnttaccaagctaaagtaatggtagtaactacgtaactttagacggtatcgtaancgtttaccggcggggaccacgggtaacccgtggtaccccg

SEQ ID NO: 416893 - DNA, 585 bp, Homo sapiens
  misc_feature: GZ8MTXP02H91GF.52.26.C04.1.454.CMB.2.raw
  modified_base (232)..(232): a, c, t, g, unknown or other
  modified_base (313)..(313): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctccccagatgggtcctgtcccagctgcagctgcaggagtcgggccccaggcctggtaaagccttcggagaccctgtcccctcacctgcactgtctctggtcncctccatcagcggtcatggttactcgtggggctggactccgccacgcccccaggggaacgggctggagtggattggaaatntctattatagtgggagcacctcctactaccaaccccgtcctcgaggacgtcgagtcactatctccgtagacctaccgtccaaacgaacctacgttccctaccctagaacgtctaggacgtcttctgtcggaccccgccgcgagaccgtacgggtctttagtttactacgtgtgaccgtagacagttacaagtctaaaataagtggttagaactactactttagcggttatcgaacgtacgttcggtacgggaccgaccggtaccgtcgtccg

SEQ ID NO: 416894 - DNA, 645 bp, Homo sapiens
  misc_feature: GZ8MTXP02HKAZZ.52.26.C04.1.454.CMB.2.raw
  modified_base (232)..(232): a, c, t, g, unknown or other
  modified_base (404)..(404): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctaggtaaagccttcggacgaccctgtcccctcacctgcactgtctctggtcncctccatccagcggtcagtggttacttcgtggggctggactccgccacgcccccgaggggaacggggctagggagtggagttagggaaatatactaattagtaggtgggagccacctcctaactaaccaaccccgtcctaccgaggacgtcgagtacacttatactccgtanacacgtaccaaacgaaaccagttacctccagaacgctgacgtctctgtacgacccgccgacacgaccgtacggtctttagtttaattaccgtgtcggacgtaacgaactatacctaaaggacctaaaattaacgtagggttaggaaacttaaaccgtacttttaggacggttaagttacgtaaccgtaagtttcccggtacgggggacccgtaaccgggtaacccgttacgggttaacccc

SEQ ID NO: 416895 - DNA, 569 bp, Homo sapiens
  misc_feature: GZ8MTXP02JB9PQ.52.26.C04.1.454.CMB.2.raw
  modified_base (229)..(229): a, c, t, g, unknown or other
  modified_base (328)..(328): a, c, t, g, unknown or other
  modified_base (354)..(354): a, c, t, g, unknown or other
  modified_base (384)..(384): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtcccctcacctgcactgtctctggtncctccatcagcggtcatggttacttcgtggggctggactccgccacgcccccgagggaacgggctggagtggattggaaatgtctattagtaggtggancacctcctacctaccaaccccgtccnccgaggacgtcgagtcactatcgtccgtanaccacgtaccaaacgacccagttcctccctagaacgtctagagtctctagtcgacccgccgcagaccgacggtattagtttacttactgtacgacgagactatactaagacaaataagtgtagatactacttagtaggtatcgaactagttccggtacgggaccgaacgggtacctcggtacccg

SEQ ID NO: 416896 - DNA, 596 bp, Homo sapiens
  misc_feature: GZ8MTXP02GJSDR.52.26.C04.1.454.CMB.2.raw
  modified_base (305)..(305): a, c, t, g, unknown or other
  modified_base (375)..(375): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctcatcagcggtcatggttacttctggggctggatccgccagcccccgagggaagggctggagtggattggaaatntctatatagtggagcacctcgtaactaccaaccccgtcctccgaggacgtcgagtcacttatctccgtanacaccgtaccaaagaacctacgttcctccctagaacgtccgtgaacgctcgttgcgaacccgccgcacggacacgggtcttagtttactacgtgtcgacgagtactactactaagcaaaattaacgtggtaggtaactaccgtaacttagtcggtaagtttcggaacttaacgtttccgtcgggggtaccctaacggggtaaccccgttcggttaaccccg

SEQ ID NO: 416897 - DNA, 646 bp, Homo sapiens
  misc_feature: GZ8MTXP02HFRTY.52.26.C04.1.454.CMB.2.raw
  modified_base (333)..(333): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctcatcgagtcggtcagttggttactcgtggggctggactccgccacggcccccgaggggaacgggctggagtggtattgggaaatatctattagtaggtggancctacctcctactacctaacccgtcctacgaggacgtcgacgtacactatgtacgtacgacacgtaccaaagaccctacggtttaccctaccgtagaaacgcgtagacgtcttcgtacggtccgacccgaccgctaacggaccgtaacggtctttagtttacgttacgtaggacgacgagtaccgtatacgtaagtactaaaagtaacgtggtaaagtacttaacaacgtttacgtaaggggtactttacggaaccgttaacggttccgggtacggggaacccgtaacggggtaccccgtacggttaaccccg

SEQ ID NO: 416898 - DNA, 643 bp, Homo sapiens
  misc_feature: GZ8MTXP02FMXFY.52.26.C04.1.454.CMB.2.raw
  modified_base (333)..(333): a, c, t, g, unknown or other
  modified_base (420)..(420): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggacgaccctgtcccctcacctgcactgtctctggtgcctccatcacgcggtcattggttacttcgtggggctggactccgccacgcccccgaggggacgggctggagtggataggaaatagtctagttataggtggganccactcctactaccaaccccgtcctcaggtacgtcgagtcactatacgtccgtagacacgtaccaagacctagtcctccctagaacnctagacgtctcgtgtcgaccgcgcacgacacggcttagtttactacgttgacgcgtaagactaacgttcgtaaacgtaactaaaagttaaacgttgggaggttaaacttaaacccgttaaacgttttacggaacggggttagggttttaacccgtaaccgtttaaccggttccggaccgggggttaacccggtaaacccggggtaacccgtttcggtaccccg

SEQ ID NO: 416899 - DNA, 570 bp, Homo sapiens
  misc_feature: GZ8MTXP02FR93T.52.26.C04.1.454.CMB.2.raw
  modified_base (428)..(428): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagccggcctcgagggactcccctgagcgtattcctcgtcgggcctccaaactccgtagggaaaccacgacgcccaacttccgcgaacccatccgaaggcccgggtaacccagggccttaaggnggagtggacgtcgtagtacttagttacgtcgtacgagggcggtacggacagacctaacgtcgtggtaggttacggtcgggacgggacggaaccgagtccgtaacggtacccgtacgtacggaccgaccggaccgacggcccg

SEQ ID NO: 416900 - DNA, 647 bp, Homo sapiens
  misc_feature: GZ8MTXP02IY6L8.52.26.C04.1.454.CMB.2.raw
  modified_base (311)..(311): a, c, t, g, unknown or other
  modified_base (328)..(328): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctaggtaaagcccttcggacgaccctgtcccctcacctgctactgtctctggtcgcctccatcagcggtcattggttacttgtgggctggactccgccacgccccgagggaggctggagtggataggaaatntactatagtagtggacnctacctacctactaccaaccccgtcctacacggacgtcgacgtcaactatacgtccgtagaccaccgtaccaaacgtaaacctacgtttccaccctaggaaacgctaggaacgtctcgtcgtaccggacccgccgacgacggaccgacggtacgttttagttaaactttcgtgtacgtacggaacgtacctaattaccgaaacgtactaaaattacgtaggtaaccggaaattaaacgtaactttaggtaggttacgttacggtaactacggtttaccggacggggaccgtaaccgggtaacccgttcgggttaacccc

SEQ ID NO: 416901 - DNA, 582 bp, Homo sapiens
  misc_feature: GZ8MTXP02F6521.52.26.C04.1.454.CMB.2.raw
  modified_base (311)..(311): a, c, t, g, unknown or other
  modified_base (326)..(326): a, c, t, g, unknown or other
  modified_base (389)..(389): a, c, t, g, unknown or other
  modified_base (393)..(393): a, c, t, g, unknown or other
  modified_base (427)..(427): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtgcctccatcagcggtcatggttacttcgtggggctggactccgccacgcccccgagggaacgggctggagtggattaggaaatntctatataggtggancacctctactaccaacccgtcctacgaggacgtcgagtcactatctcgagacacgtcaagacnttcncctagaacgctgacgtctcgtagtcgaccgccgngaacgacacgtcttagtttactacgtgtacgacgacgactattacaaagactaaaattaaacgtggtaaggtaactaactaacgtttagtacggtagtttacgcgtaacgttccggttcgggggacctaaccgggggtaaccctcggttaccccg

SEQ ID NO: 416902 - DNA, 694 bp, Homo sapiens
  misc_feature: GZ8MTXP02F20D8.52.26.C04.1.454.CMB.2.raw
  modified_base (323)..(323): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctaggtaaacgccttcggacgaccctgtcccctcacctgcactgtctctggtcgcctccatcagcggtcagttggttacttcgtggggctggactcccgccacgcccccgaggggaacgggctgggagtggtattaggaaattntcttaattagtaggtgggacgtcctaaccttaccctacctaacccgtaaaccccgttccctaccgaacggtacgtacggacgttactaacttaacgttaccgtacccgtaaacggtaacccgtaacccgttacccaaaacggtaaaccccgttacggtttacccctacccgtaaggaaacgtccttagggaacctccttacgttcgtaccggaccccgacccgacgtaaacggacccgtaacgggttctttaacgtttactaccggtgtcgacgtaagactactacgtaagactaaattacgtggtagactagtacttgtagtacgttgaacgtacgttcggacggggtacgacggtacccgtgtaccccg

SEQ ID NO: 416903 - DNA, 672 bp, Homo sapiens
  misc_feature: GZ8MTXP02F5JL4.52.26.C04.1.454.CMB.2.raw
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtcgcctccatcagcgtcatggttacttcgtgggctggatccgccacgcccccgagggaacgggctggagtggattggaaatagtacttattataggtggacgcaccgttcctaactaccaaaccccggtcctaccgacggacgtacgacgtccaacttaactacgtaccgtaacgaaccgtacccgtaccaaacggaacctacgtttccctccctaggaaagccttgaacgtctccgttggaccgaccggccgacaacggaaccacgggttccttaggtttaactttaacgtggttacgcggaagtacgaactaccgtaaagaccgtaaaattaagttacggttaggtaaacttaactaacgtttaaagtcggtaagtttgtaacggtactttaccgggtcggggaaccccgtaacggggtaaaccccgttcggggttaacccccg

SEQ ID NO: 416904 - DNA, 701 bp, Homo sapiens
  misc_feature: GZ8MTXP02G7OAC.52.26.C04.1.454.CMB.2.raw
  modified_base (232)..(232): a, c, t, g, unknown or other
  modified_base (314)..(314): a, c, t, g, unknown or other
  modified_base (413)..(413): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaacgccttcggacgaccctgtccctcacctgcactgtctcgtggtcncctcatcagcggtcagtcggttacttcgtggggctggactccgccacgccccgagggacgggctggagtggagtaggaaatntactatagtaggtggacgcctaccgttacctaacctacccgaaaccccgttcctaccgaggtacgtacgacgtacctaacttaactacgtacccgtaanaacccgtaccgttacccaaaacggaccctacgtttaccctacccgtagaaacgtcgttacggacgtcttcgtcggtaccgacccgccgacgaacgaccgtacggtctttagtttactacgttacgcggtacgacgtaactacttacgtaaacgtactaaaattacgtggttaacggtaactttaaaccgtaacgttttacgggaggttacggttacgtaaccgttaccggttacccgggtacgggggtaacccgtaaaccggggttacccgtacgggtttaacccccg

SEQ ID NO: 416905 - DNA, 626 bp, Homo sapiens
  misc_feature: GZ8MTXP02GKLBK.52.26.C04.1.454.CMB.2.raw
  modified_base (197)..(197): a, c, t, g, unknown or other
  modified_base (229)..(229): a, c, t, g, unknown or other
  modified_base (308)..(308): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcgganaccctgtccctcacctgcactgtctctggtcncctcatcagcgtcagtgttactcgtggggctggactccgccacgcccccgagggaacgggctggagtggattggaaatntactattagtagtggagcacctcgtactacaaccccgtcctacgaggacgtcgacgtcacttatctccgtagacaccgtaccaaacgacctagttccctacctaggaaactcctagactctcgtcgtacggaacccgccgacgaaacgaccgtaccggtcgtttacgtttatttaccgtgttcgaccggtaaagtactactacgtaagtaactaaagttacgtacgtaggtaacttacgttaacgttaggtacggtacgttagtaaccgttacggttccgggtacggggtaccgtaaccgggtacccgtacggtaccg

SEQ ID NO: 416906 - DNA, 694 bp, Homo sapiens
  misc_feature: GZ8MTXP02GFOGK.52.26.C04.1.454.CMB.2.raw
  modified_base (236)..(236): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgctggtggcggctcccagatgggtcctgtcccagctgcagctgcaggagtcgggcccaggccctggtaaaacgccgttacggacgaccctgtcccctcacctgcactgtctctggtcncctcatcagcgtcagttgttactcgtgggctaggctccgaccacggcccccgaaggggtagggcgtaggagtggtagttaggaaatatactaagttagtaggtagggatcctacctcctaactaaccgaaccccgtcctacgaggactcgagtacaactatcgtacgagactaaccgtaccaaagaaccctagttaccctacccgtagaaacgtcgtaggaactcctacgttggacccgacccggccgacgtaacggaacctaccggtcgttttagtttaactaccgtgtagaccggaaagtaccctaattacgaaacggacttaaaaactaagttcggtaaggttaattaaaccgtaaagtttacgtaccggggaattttcccggaacttttaccggttaccggggtacgggggaacccgttaaccggggtaaacccccggtttggttaacccccgg

SEQ ID NO: 416907 - DNA, 586 bp, Homo sapiens
  misc_feature: GZ8MTXP02IJ62P.52.26.C04.1.454.CMB.2.raw
  modified_base (227)..(227): a, c, t, g, unknown or other
  modified_base (254)..(254): a, c, t, g, unknown or other
tcagcgcagtacgacacgaccggtgctcgatttagtctagcgactttgggtttggggctttctgagagtcatggatctcatgtgcaagaaaatgaagcacctgtggttcttcctcctgctggtggcggctcccagatgggtcctgtcccagctgcagctgcaggagtcgggcccaggcctggtaaagccttcggagaccctgtccctcacctgcactgtctctggtncctccatcagcgtcatggttacttcgnggggctggactccgccacgacccccgaggggaacgggcgtaggagtggattaggaaatatactaattataggtggagcacctcctactacaacccgtcctcgagacgtcgagtcactatactacgtagaccacgtaccaagaacctacgttcctacctgaaacgctagacgtctctggtcgaccgccgacaagaccgtacggtctttagtttactttactcggtagacgtaagactagtaactaagactaaattacgtagtagtaactaataacgttagtacggtattagaacttagttccgtacgggaccgacggtaaccgtggtaacccg

SEQ ID NO: 416908 - DNA, 648 bp, Homo sapiens
  misc_feature: GZ8MTXP02H7RNC.52.26.C04.1.454.CMB.2.raw
  modified_base (224)..(224): a, c, t, g, unknown or other
  modified_base (258)..(258): a, c, t, g, unknown or other
  modified_base (306)..(306): a, c, t, g, unknown or other
  modified_base (456)..(456): a, c, t, g, unknown or other
tcagcgcagtacgacacgaccggtgctcgatttagtctagcgactttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctgganatgaagttggggaaattaagttgcttgctggtancaccagaacgccaggcctacgtcccctgtcctgtcatctatacaagtntgtacaagccgacccctaggacgggtacctccccgtaggacgtcgtatttccgtctcggtcctacctaaacgtccgtaagggaaccacgacgtaccctatccgtacgaaccctagtacccgacggcccggggaacccctagggacttagnggggaaattcgggaacgggtctacggtaaacctttacgtttacgcggttacgaggggtaccgggtagggaacctaggacctaaaaccgtgttacggggttacggttaacgtaccgggggacggtaccggggaacaacggtccgtaaccggtcccgttacggtacgaccgtacccggacccaacgggtccccg

SEQ ID NO: 416909 - DNA, 590 bp, Homo sapiens
  misc_feature: GZ8MTXP02JKV9M.52.26.C04.1.454.CMB.2.raw
  modified_base (231)..(231): a, c, t, g, unknown or other
  modified_base (315)..(315): a, c, t, g, unknown or other
  modified_base (329)..(329): a, c, t, g, unknown or other
  modified_base (421)..(421): a, c, t, g, unknown or other
  modified_base (509)..(509): a, c, t, g, unknown or other
tcagcgcagtacgacacgaccggtgctcgatttagtctagcgactttggggtttgggggctttctgagagtcatggatctcatgtgcaagaaaatgaagcacctgtggttcttcctcctgctggtggcggctcccagatgggtcctgtcccagctgcagctgcaggagtcgggcccaggcctaggtaaagccttcggagaccctgtcccctcacctgcactgtctctggtncctccatcagcggtcagttggttacttcgtggggctggactccgccacgcccccgaggggaagggcgtggagtggatggaaatntctatatagtggancacctctactaccaacccgtcctacgacggagtcgagtcaactatactaccgtagacaccgtacaaacgtaacctagttcctccctagaacnctagacgtctcgtacgcgacccgccgacgaagaccgtacggtctttagtttacttacgtgtagaccgaagtactactactaaacgtanaataaagtcgaagtactaactaacgttatagggtactgtaacgtacgttcggacggggcgtaacgggtacctcggtacccg

SEQ ID NO: 416910 - DNA, 607 bp, Homo sapiens
  misc_feature: GZ8MTXP02F6J07.52.26.C04.1.454.CMB.2.raw
  modified_base (322)..(322): a, c, t, g, unknown or other
  modified_base (338)..(338): a, c, t, g, unknown or other
  modified_base (520)..(520): a, c, t, g, unknown or other
  modified_base (568)..(568): a, c, t, g, unknown or other
tcagcgcagtacgacacgaccggtgctcgatttagtctagcgactttgggtttgggggctttctgagagtcatggatctcatgtgcaagaaaatgaagcacctgtggttcttcctcctgatggtggcggctcccagatgggtcctgtcccagctgcagctgcaggagtcgggcccaggcctaggtaaacgccttcggagacccctgtcccctcacctgcactgttctcgtggtcgccctccatcaggtccggtctagttggttaccttcgtggggctggactccgccacggccccgaggggacggctggagtgataggaatntatattataggtgganccacctacctaacctaccaaccccgtccaccgaggacgtcgagtcaacctatacgtaccgtaagaccacgtaaccgaaacgtaaccgtacgttaccctacccgttagaacgcttacggagtctacgtggtccgaaccccgccgcgaacgaccgacgttctaagtttctacgtggtacacganacctatacaagactaatatagtcgaatactaattatcgtacggtttanaacgtacgtcggtacggaccgtacggtaccgtacgtccg

SEQ ID NO: 416911 - DNA, 505 bp, Homo sapiens
  misc_feature: GZ8MTXP01EAV99.19.78.H01.1.454.CMB.2.raw
  modified_base (478)..(478): a, c, t, g, unknown or other
  modified_base (482)..(482): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaaccttgtctctgtaccaacatcacccaaataaagcccccaaaactcatcatttatgatgccactaagcggccctcagggggtttctaatcgcttctcctggctccaagtctggcaacacgcctccctgacaatctctgggctccaggctgaggacgaggctgattacactgctggctcatatgcagtcgtatctcttatgtcttcggaacttgggaccaaggtcacgttcnggcngcccaagccacccatcgttcaac

SEQ ID NO: 416912 - DNA, 514 bp, Homo sapiens
  misc_feature: GZ8MTXP01D7K6M.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtacaacatcaccaaataaagccccaaactcatcatttatgatgccactaagcggccctcagggggtttctaatcgcttctcctggctccaagtctagggcaacacggcctccctgacaatctctgggctccaggctgaggacgaggctgattactactgctggctcatatgcaggtcgtatctcttatgtcttcggaattggggaccaaggtcaccgttcttggttcaagcccaaggccaacccactcgttctaacc

SEQ ID NO: 416913 - DNA, 525 bp, Homo sapiens
  misc_feature: GZ8MTXP01AJYMT.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcacccaaataaacgcccccaaactcatcatttatgatgccactaagcggccctcagggggtttctaatcgcttctcctggctccaagtctggcaacacggcctccctgacaatctctgggctcaggctgaggacgaggctgattactactgctggctcatatgcaggtcgtatctcttatgtcttcggaacttggggaccaagggtcacgttcgttcgttacgtcaccgaaccgacgaccccacctcgttcgtaacc

SEQ ID NO: 416914 - DNA, 499 bp, Homo sapiens
  misc_feature: GZ8MTXP01DNO30.19.78.H01.1.454.CMB.2.raw
  modified_base (258)..(258): a, c, t, g, unknown or other
  modified_base (271)..(271): a, c, t, g, unknown or other
  modified_base (290)..(290): a, c, t, g, unknown or other
  modified_base (365)..(365): a, c, t, g, unknown or other
  modified_base (396)..(396): a, c, t, g, unknown or other
  modified_base (398)..(398): a, c, t, g, unknown or other
  modified_base (407)..(407): a, c, t, g, unknown or other
  modified_base (409)..(409): a, c, t, g, unknown or other
  modified_base (414)..(414): a, c, t, g, unknown or other
  modified_base (419)..(419): a, c, t, g, unknown or other
  modified_base (421)..(421): a, c, t, g, unknown or other
  modified_base (423)..(423): a, c, t, g, unknown or other
  modified_base (426)..(426): a, c, t, g, unknown or other
  modified_base (432)..(432): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacgagggtcctgggcccagtctgccctgactcagtctgcctccgtgtctggtctcctggacagtcgtcacatctctgcactggaaccagcagtgatgttgaaattctaactgtctctgtacaantcaccaaataaanccccaaactcatcatttangatcgaccactaagcggtcccctgtaggggtttcaatcgcttctctggctccaagtctggcaacacgccttcccngacaatctctggctccaggctgagacgaggntnatactactntntgctntatangngngtntatctntatgtctcgtacgttacgacgacgtacgtacgttcgttcgacaacaccaacaccaccactcgttctc

SEQ ID NO: 416915 - DNA, 499 bp, Homo sapiens
  misc_feature: GZ8MTXP01D9OTN.19.78.H01.1.454.CMB.2.raw
  modified_base (275)..(275): a, c, t, g, unknown or other
  modified_base (458)..(458): a, c, t, g, unknown or other
  modified_base (487)..(487): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataaanccccaaactcatcatttatgatgaccactaagcggccctcagggggtttctaatcgcttctcctggctcaagtctgcaacacgcctccctgacaatctctggctcagctgagacgaggctgattacactgctggctcatatgcaggtcgtatctcttatgtcttcggaattgggacaaggtcncgttcttggttcaagcccaagcccaaccnctcgttctaacc

SEQ ID NO: 416916 - DNA, 508 bp, Homo sapiens
  misc_feature: GZ8MTXP01D1WHG.19.78.H01.1.454.CMB.2.raw
  modified_base (425)..(425): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaactgtctctgtacaacatcaccaaataaagccccaaactcatcatttatgatgccactaagcggccctcaggggtttctaatcgcttctcctggctccaagtctaggcaacacggccctccctgacaatctctgggctcaggctgaggacgaggctgattactactgctggctcatangcaggtctatctcttatgtcttggaacttgggacagtcacgttcgttaggttcaacgccaaggcccaacccatcgttctaacc

SEQ ID NO: 416917 - DNA, 537 bp, Homo sapiens
  misc_feature: GZ8MTXP01EVEKO.19.78.H01.1.454.CMB.2.raw
  modified_base (263)..(263): a, c, t, g, unknown or other
tcagtactctcgtgcacgaccggtgctcgatttagtgtgagtagtttgggtttggggggtcacaagagcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtaccaanatcaccaaataaacgaccccaaactcatcatttatgatgccactaagcggccctcgtagggtttctaatcgcttctctggctcaagtctgcaacacgcctcctgacatctctgggctccgaggctggaggacgagctgattactactgctggctcatatgcgtaggttcgtattctcttatcgttcgttaacggtaaacgttcgggaaccttaaggtcctaccgttcccgttaggttccaacgcccaacggcccaaccccgatcgttctaaccc

SEQ ID NO: 416918 - DNA, 523 bp, Homo sapiens
  misc_feature: GZ8MTXP01EIJDN.19.78.H01.1.454.CMB.2.raw
  modified_base (153)..(153): a, c, t, g, unknown or other
  modified_base (362)..(362): a, c, t, g, unknown or other
  modified_base (511)..(511): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtntcctggacagtcggtcaccatctcctgcactggaaccagcagtgatgttggaaattctaaccttgtctcctggtaccaacatcacccaaataaagccccaaatcatcatttatgatgccactaagcggccctcaggggtttctaatcgcttctctggctccaagtctggcaacacggcctccctgacaatcctctgggctccaggctgnggacaggctgattacactgctgctcatatgcagtcgtatctcttatgtcttcggggaactggggaccaaggtcaccgtcaggtcagcccaaggcccaacccaactcgcacttctcgttccccacccttccttaccaacgagaagtacgngacgtcggcgtg

SEQ ID NO: 416919 - DNA, 520 bp, Homo sapiens
  misc_feature: GZ8MTXP01EZCMF.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaaagcccccaaactcatcatttatgatgccactaaagcggcccctcagggggtttctaatcgcttctcctggctccaagtctggcaacacggccctccctgacaatctctgggctccaggctgaggacgaggctgattacactgctggctcatatgcaggtctatctcttatgtcttcggaacttgggaccaagggtcaacgttcttagttcaagcccaaggcccaacccactcgctaacc

SEQ ID NO: 416920 - DNA, 518 bp, Homo sapiens
  misc_feature: GZ8MTXP01BZU5L.19.78.H01.1.454.CMB.2.raw
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtacacatcacccaaataaagcccccaaactcatcatttatgatgccactaagcgccctcagggggtttctaatcgcttctcctggctccaagtctaggcaacacggccctccctgacaatctctgggctccaggctgaggacgaggctgattactactgctggctcatatgcaggtcgtatctcttatgtcttcggaacttggggaaccaggtcaccgttccttgggttccaagccccaaggcccaacccactcgttcctaac

SEQ ID NO: 416921 - DNA, 509 bp, Homo sapiens
  misc_feature: GZ8MTXP01CSKSZ.19.78.H01.1.454.CMB.2.raw
  modified_base (436)..(436): a, c, t, g, unknown or other
  modified_base (497)..(497): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcacccaaataaagcccccaaactcatcatttatgatgccactaagcggccctcaggggtttctaatcgcttctcctggctccaagtctggcaacacggcctccctgacaatctctgggctccaggctgaggacgaggctgattactactgctggctcatatgcaggtctatctnttatgtctcggaacttgggtaccagtccacgttcgttggttcaagcccaaggcccaacccnctcgttctaacc

SEQ ID NO: 416922 - DNA, 509 bp, Homo sapiens
  misc_feature: GZ8MTXP01BOGEV.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacacatcacccaaataaagcccccaaactcatcatttatgatgccactaagcggccctcagggggtttctaatcgcttctcctggctccaagtctggcaacacggccctccctgacaatctctgggctccgaggctgaggacgaggctgattactatgctggctcatatgcgagtcgtatctcttatgtctcggaacttgggacaggtcacgttcgttgttcaacgccaacggccaacccactcgctaacc

SEQ ID NO: 416923 - DNA, 507 bp, Homo sapiens
  misc_feature: GZ8MTXP01AFVUJ.19.78.H01.1.454.CMB.2.raw
  modified_base (473)..(473): a, c, t, g, unknown or other
  modified_base (497)..(497): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcaccaaataaagcccccaaactcatcatttatgatgccactaagcggccctcaggggtttctaatcgcttctcctggctccaagtctggcaacacggccctcctgacaatctctgggctccgaggctgagacgaggctgattacactgctggctcatatgcaggtctatctcttatgtcttcggaacttggggaccaggtcaccgttcnggttcaagcccaaggcccaacccnctcgctaacc

SEQ ID NO: 416924 - DNA, 514 bp, Homo sapiens
  misc_feature: GZ8MTXP01E1OJL.19.78.H01.1.454.CMB.2.raw
  modified_base (429)..(429): a, c, t, g, unknown or other
  modified_base (435)..(435): a, c, t, g, unknown or other
  modified_base (437)..(437): a, c, t, g, unknown or other
  modified_base (440)..(440): a, c, t, g, unknown or other
  modified_base (446)..(446): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaacccaaataaagcccccaaatcatcatttatgatgcactaagcggccctcaggggtttctaaatcgcttctcctggctccaagtctaggcaacacggcctccctgacaatctctgggctccagggctgaggacgaggctgattactactgctcgctnatatgngngtntatctnttatgtctcgtacgaggacgacgtcgtacgttcgttcgcaacgaccgaacgaccacccactcgttctc

SEQ ID NO: 416925 - DNA, 506 bp, Homo sapiens
  misc_feature: GZ8MTXP01BTW4H.19.78.H01.1.454.CMB.2.raw
  modified_base (467)..(467): a, c, t, g, unknown or other
  modified_base (473)..(473): a, c, t, g, unknown or other
  modified_base (495)..(495): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataaagcccccaaactcatcatttatgatgccactaagcggccctcagggggtttctaatcgcttctcctggctccaagtctggcaacacggcctccctgacaatctctgggctccaggctgaggacgaggctgattacactgctggctcatatgcaggtctatctcttatgtctcggaacttgggacaggtcncgttcngttcaagcccaaggccaacccntcgttctaacc

SEQ ID NO: 416926 - DNA, 505 bp, Homo sapiens
  misc_feature: GZ8MTXP01DGQ3H.19.78.H01.1.454.CMB.2.raw
  modified_base (380)..(380): a, c, t, g, unknown or other
  modified_base (423)..(423): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccaacatcacccaaataaacgcccccaaactcatcatttatgatgccactaagcggccctcagggggttttctaatcgcttctcctggctccaagtctaggcaacacggcctccctgacaatcnctgggctccaggctgaggacgaggctgattacactgctggctnatatgcaggttctatctcttatgtcttggaacttgggaccaaggtcacgttcttggcaagcccaaggccaaccccatcgctc

SEQ ID NO: 416927 - DNA, 518 bp, Homo sapiens
  misc_feature: GZ8MTXP01CR824.19.78.H01.1.454.CMB.2.raw
  modified_base (509)..(509): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctggtaccaacatcacccaaataaagccccaaactcatcatttatgatgccactaagcggccctcaggggtttctaatcgcttctctggctcaagtctagggcaacacggccctccctgacaatctctgggctccaggctgaggacgaggctgattactactgctggctcatactgcaggtctatctcttatcgtcttcggaacttggggaaccaggtcacgttccgttggttcaagcccaaggcccaacccntcgttcaac

SEQ ID NO: 416928 - DNA, 528 bp, Homo sapiens
  misc_feature: GZ8MTXP01B1ONE.19.78.H01.1.454.CMB.2.raw
  modified_base (370)..(370): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacaacatacaccaaataaacgccccaaactcatcatttatgatgccactaagcgccctcagggtttctaatcgcttctcctggctcaagtctaggacaacgacgcctcccngacaactctctggctcagctgagacgagctgattacactgctggctcatatgcaggtctattctcgttatcgtcttaacggaacttcgggaaccaggtcctaccgttccgttaggttaccaagccccaaacggcccaacccttactcgttctaacccg

SEQ ID NO: 416929 - DNA, 515 bp, Homo sapiens
  misc_feature: GZ8MTXP01CRPPV.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcacccaaataaagcccccaaatcatcatttatgatgccactaagcggccctgagggggtttctaatcgcttctcctggctcaagtctaggcaacacggcctccctgacaatctctgggctccaggctggaggacgaggctgattacatgctggctcatatgcaggtctatctcttatgttcttcggaacttggggaccaggtccaccgttccgttggcaacgcccaacggcccaacccgctcgttcctaacc

SEQ ID NO: 416930 - DNA, 816 bp, Homo sapiens
  misc_feature: GZ8MTXP01CZ6RH.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaacccaaataaacgaccccaaactcatacatttatgatcgaccaactaaacgccggtacccttacgtaacgggggtttttactaaacgttccgtccttttaccgttccccgttcggggtaccttacccgtaaaacggttcccgttaacggggacccaaacccgtacccgggtcccctttacccccgttaggaaaccctaaacgttccttaccggttcgggggtacccttaccccggaagggcccgttagggaaacggggtaacccgggaaaggggtcccttaagggtaaacttttaaacctaaccgttagggtacctttcggggtacccttttaaccgaatttaaccgttggacccgtaagggggtttccttaaactttccgttaccttttagtcggtttacgtttaaccggggtaaaactttcgggggaaacccttaaacggggttaccctaacccggtttacccgttacggggttacccaaccgggaaccccctaaaacggggtacccccaaaaccccccggttaattccggttaaccgtaaccccg

SEQ ID NO: 416931 - DNA, 525 bp, Homo sapiens
  misc_feature: GZ8MTXP01ANUVQ.19.78.H01.1.454.CMB.2.raw
  modified_base (439)..(439): a, c, t, g, unknown or other
  modified_base (494)..(494): a, c, t, g, unknown or other
  modified_base (518)..(518): a, c, t, g, unknown or other
  modified_base (524)..(524): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatacaacccaaataaacgacccccaaaactcatcatttatgatgccaactaacgcggccctcgtaggggtttctaatcgcttctcctggctccaagtctaggcaacacggccctccctgacaatctctgggctccaggctggaggacgaggctgattactactgctggctnatatgcaggtctatctcttatgtcttcggaacttggggaccaaggtcacgttcgnggttcaagcccaaggcccaacccnctcgcnc

SEQ ID NO: 416932 - DNA, 542 bp, Homo sapiens
  misc_feature: GZ8MTXP01CT8VG.19.78.H01.1.454.CMB.2.raw
  modified_base (263)..(263): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaanatcacccaaataaacgcccccaaatcatcatttatgatgccactaagcggccctcaggggtttctaatcgcttctcctggctcaagtctaggcaacacggcctccctgacaatctctgggctccaggctggaggacgaggctgattacgtactgtcctggacttcatagtgctaggtcttatctctttatgttcttaacggaacgttgggaaccaggtaccaccgttaccgttaggttccaacgccccgaaggccccaaaccccactcgttcctaaccc

SEQ ID NO: 416933 - DNA, 511 bp, Homo sapiens
  misc_feature: GZ8MTXP01D1PSA.19.78.H01.1.454.CMB.2.raw
  modified_base (391)..(391): a, c, t, g, unknown or other
  modified_base (408)..(408): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacgccccaaactcatcatttatgatgaccactaaacgcggccctcgagggggttttctaactcgcttctcctggctccaagtctaggcaacacggccctccctgacatctcnggctcagctgaggacgnggctgattacatgctggctcatatgcaggttcgtatctcttatgtctcggaacttgggacaaggtcacgttcttggttcaagcccaagcccacccatcgctcc

SEQ ID NO: 416934 - DNA, 541 bp, Homo sapiens
  misc_feature: GZ8MTXP01EA1P3.19.78.H01.1.454.CMB.2.raw
  modified_base (209)..(209): a, c, t, g, unknown or other
  modified_base (224)..(224): a, c, t, g, unknown or other
  modified_base (262)..(262): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatcncctgcactggaaccngcagtgatgttagaaattctaacttgtctctgtacaanatcaccaaataagccccaaactcatcatttatgatgccactaagcggccctcgtagggggtttctaaatcgcttctcctggctccaagtctggcaacacggcctccctgctaaatctctgggctccaggctgaggacgaggctgattactactgctggctcatatgcaggttctaattctcttattcgtcgttaacggaacgttgggacccttaaaggtccgtaacccgcgttacggccaacgccccaaaggccccaaaccccactcgttaacctcccg

SEQ ID NO: 416935 - DNA, 549 bp, Homo sapiens
  misc_feature: GZ8MTXP01DMEFK.19.78.H01.1.454.CMB.2.raw
  modified_base (285)..(285): a, c, t, g, unknown or other
  modified_base (471)..(471): a, c, t, g, unknown or other
  modified_base (537)..(537): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcagtgatgttaggaaattctaaccttgtctctgtaccaacatacaccaaataaacnccccaaactcatcatttatgatgaccactaacgccgccctacgtaggggtttctaatcgtcttctcctcggctaccaagtctaggaccaacgaccggccctccctagaacaactctcgtgggctccgaggctagacggacgaggctagacttactactgctggctcatagtgcgtagtcgtatctnttatcgtcttaacggacgttgggaaccagtccaccgttcgttagttccaagcccaacgcccacccnctcgttctaacc

SEQ ID NO: 416936 - DNA, 538 bp, Homo sapiens
  misc_feature: GZ8MTXP01EOUUT.19.78.H01.1.454.CMB.2.raw
  modified_base (321)..(321): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtacaacatcacccaaataaacgcccccaaactcatcatttatgatgccactaagcggccctnagggtttctaatcgcttctcctggctcaagtctaggcaacacggcctccctgacaatctctgggctccgaggctgaggacgagctgattactactgctggctcatatgcaggtctatctcttatgtcttaacggaacttggggaacccttaaagggtcctaaccgttcgttacggttcaacgaccccaacggccccaaccccactcgttcctaaccc

SEQ ID NO: 416937 - DNA, 517 bp, Homo sapiens
  misc_feature: GZ8MTXP01EIQ28.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagccccaaactcatcatttatgatgccactaagcggccctcaggggtttctaatcgcttctctggctccaagtctaggcaacacggcctccctgacaatctctgggctccagctgaggacgaggctgattacactgctggctcatatgcagtcgtatctcttatcgtcttcggaacttgggaccaggtccaacgttccgttaggttcaacgcccaacggcccaacccgactcgttctaacc

SEQ ID NO: 416938 - DNA, 521 bp, Homo sapiens
  misc_feature: GZ8MTXP01DRV15.19.78.H01.1.454.CMB.2.raw
  modified_base (274)..(274): a, c, t, g, unknown or other
  modified_base (509)..(509): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacacatcacccaaataaanccccaaactcatcatttatgatgccactaagcggccctcagggggttttctaatcgcttctcctggctccaagtctggcaacacggcctccctgacaatctctgggctccaggctgaggacgaggctgattactactgctggctcatatgcaggtctatctcttatgtcttcggaacttgggaccaaagggtccaccgttcccgttggttaccaaggacccaaggcccaaacccnctcgttctaacc

SEQ ID NO: 416939 - DNA, 518 bp, Homo sapiens
  misc_feature: GZ8MTXP01DUOEY.19.78.H01.1.454.CMB.2.raw
  modified_base (296)..(296): a, c, t, g, unknown or other
  modified_base (359)..(359): a, c, t, g, unknown or other
  modified_base (415)..(415): a, c, t, g, unknown or other
tcagtactctcgtgcacgaccggtgctcgatttagtgtgagtagtttgggtttggggggtcacaaaaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgctctgtacaacatcaccaaataaacgccccaaatcatcatttangatgccactaagcggccctcgtagggtttctaatcgcttctctcggctcaagtctggacaacncggcctccctgacaatctctgggcctccgaggctgaggacgaggctgattactacngctgctcagtatgacaggtctatctcttatgtcttggaactgggaccaggttccacgtccttaggttcacggcccaaggcccaacccgattcgtcaacttccc

SEQ ID NO: 416940 - DNA, 502 bp, Homo sapiens
  misc_feature: GZ8MTXP01D54FM.19.78.H01.1.454.CMB.2.raw
  modified_base (427)..(427): a, c, t, g, unknown or other
  modified_base (437)..(437): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacacaaatcacccaaataaacgcccccaaaactcatcatttatgatgcactaagcgccctcaggggtttctaatcgcttctctggctccaagtctagcaacacggcctccctgacaatctctgggctccaggctgaggacgaggctgattactactgcttggctcatatgcngtcgtatctnttatgtctggaacttgggaccttaggcacgttcttggttcaagcccaagcccacccatcgctaac

SEQ ID NO: 416941 - DNA, 546 bp, Homo sapiens
  misc_feature: GZ8MTXP01E0DOR.19.78.H01.1.454.CMB.2.raw
  modified_base (437)..(437): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcaacccaaataaacgcccccaaactcatcatttatgatgccactaagcggccctcgaggggtttactaatcgcttctcctggctccaagtctaggcaacacggcctccctgacaatctctgggctccaggctgaggacgaggctgaattacactgctggctcattagngctagtctatctcttagtcgttcgtaacggtaacgttcgggaaacttacggtcctaccgttcgttagttccaacgaccccgaacggaccccaacccttatcgttcctcg

SEQ ID NO: 416942 - DNA, 513 bp, Homo sapiens
  misc_feature: GZ8MTXP01ASQSR.19.78.H01.1.454.CMB.2.raw
  modified_base (262)..(262): a, c, t, g, unknown or other
  modified_base (464)..(464): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgttagaaattctaacttgtctctgtacanatcaccaaataagcccccaaatcatcatttatgatgccactaagcggccctcgaggggtttctaatcgcttctcctggctcaagtctggcaacacgcctccctgacatctctggctcgagctgaggacgaggctgattactactgctggctcatactgctaggtcttatcttcttatgtcgtcgaacgttgggaccaggtcncgttccgttggttcaacgcccaacggcccaacccgttatcgttctaacc

SEQ ID NO: 416943 - DNA, 531 bp, Homo sapiens
  misc_feature: GZ8MTXP01C7JTX.19.78.H01.1.454.CMB.2.raw
  modified_base (300)..(300): a, c, t, g, unknown or other
  modified_base (418)..(418): a, c, t, g, unknown or other
  modified_base (425)..(425): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgttgaaattctaacttgtctcctggtaccaacatacaacccaaataaacgccccaaactcatcattangatgcactagcgcctcgagggtttcaatcgcttctcctggctacaagtctagacaacacgcctcctagacatctcgtcggctcgagctgagacgagctagattactactgctggctanattacgngcgtacgtctactcttacttagtcgtacgttaacggaacgttcggaacttacgtccgtaccgttcgttacgccgaacgacccgaacgcccaccttctcgaacctcg

SEQ ID NO: 416944 - DNA, 528 bp, Homo sapiens
  misc_feature: GZ8MTXP01E0IY0.19.78.H01.1.454.CMB.2.raw
  modified_base (445)..(445): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcacccaaataaagcccccaaactcatcatttatgatgccactaagcggcccctcagggggtttctaatcgcttctcctggctccaagtctagggcaacacgggcctccctgacaatctctgggctccaggctgaggacgaggctgattactatgctggctcatatgcaggtcgtatctnttatgtcttaacggaacttgggaccttaaggtctaccgttcgttaggttcaacgcccaaggcccaacccactcgttctaaccc

SEQ ID NO: 416945 - DNA, 519 bp, Homo sapiens
  misc_feature: GZ8MTXP01EOI0A.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaaattctaactgtctctgtacaacatcacccaaataaacgccccaaactcatcatttatgatgccactaagcgccctcaggggtttctaatcgcttctcctggctccaagtctggcaacacggcctccctgacaatctctgggctccgagctagaggacgaggctgattactactgctggctcatatgcaggtctatcttcttatcgtctcggacgttcgggaccaaaggtccaccgttccgttaggttcaacgcccaacggcccacccactcgttctaaccc

SEQ ID NO: 416946 - DNA, 561 bp, Homo sapiens
  misc_feature: GZ8MTXP01EFP8J.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagcccccaaatcatcatttatgatgccactaagcggccctcgaggggtttctaatcgcttctcctggctcaagtctaggcaacacggcctccctgacaatctctggctcagctgaggacgagctgattactatgctggctcatatgcgaggttcgtattcttcttagttcgttcgttaacgggtaacgttacggggaaccttaaacgggttccgtacccgttaccgttcggttaccaacggaccccgaacggaccccaaaccccgaccttcgttccttaaccccg

SEQ ID NO: 416947 - DNA, 515 bp, Homo sapiens
  misc_feature: GZ8MTXP01B2YCQ.19.78.H01.1.454.CMB.2.raw
  modified_base (297)..(297): a, c, t, g, unknown or other
  modified_base (380)..(380): a, c, t, g, unknown or other
  modified_base (439)..(439): a, c, t, g, unknown or other
  modified_base (506)..(506): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgtgtctcctggacagtcggtcaccatctcctgcactggaaccagcagtgatgttggaaattctaacttgtctctgtaccaacatcaccaaataaacgccccaaactcatcatttangatgcactaagccggccctcgagggtttctaatcgcttcctctggctccaagtctggccaacacggcctccctgacaatctcnggctcaggctgaggacgaggctgattactactgctgcttcatatgctaggtctatcctnttatgtcttcggaactgggaccaaggtcttaccgttcttagtcacggcccaagggcccaaacccgtnttcgtaacc

SEQ ID NO: 416948 - DNA, 512 bp, Homo sapiens
  misc_feature: GZ8MTXP01ATTM3.19.78.H01.1.454.CMB.2.raw
  modified_base (502)..(502): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtacaacatcaccaataaagcccccaaactcatcatttatgatgccactaagcggccctcaggggtttctaatcgcttctcctggctccaagtctaggcaacacgggcctccctgacaactctctgggctccaggctggaggacgagggctgattacactgcttggctcatatgcaggtctatctcttatgtctcggaacttgggaccaggtcaccgttcgttagttcaagcccaaggcccaacccntcgttcaacc

SEQ ID NO: 416949 - DNA, 845 bp, Homo sapiens
  misc_feature: GZ8MTXP01D2XNL.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtacaacatcaacccaaataaacgaccccaaactcatcatttatgatcgaccaactaaacgccggcccttacgtaacgggggttttacttaaacgttcggtcctttccttcccgtgggtaccttacccgaaaggttcccgttaacgggacccaaccgtaacccgggtccccttacccccgttacggaaccctaaacttccgttaccgttcgggggtcccttaccccgaaggggcctttagggaaacggggtaaccggaaaggggtcctttagggtaaacttttaaccggtaaacctttagggacccctttagggggtccctttaaccgtaaacgtttaaatttcggaccccggtaaggggtttaccggtttaaactttcccgtttacctttttaaagttcgggtttacccgtttaaccggggtaaaaccgttcgggggtaaaaccccgttaaacgggttaccccgtaaaccccggttttaccccggttaaacgggtttaccccgaaacccgggtaccccccgtaaaacggggtacccccccaaaaaccccccggttccttaaccggtttccccgtttaaacccccg

SEQ ID NO: 416950 - DNA, 514 bp, Homo sapiens
  misc_feature: GZ8MTXP01CL5UW.19.78.H01.1.454.CMB.2.raw
  modified_base (430)..(430): a, c, t, g, unknown or other
  modified_base (477)..(477): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctcctggtaccaacatcacccaaataaagcccccaaactcatcatttatgatgcactaagcgccctcagggggtttctaatcgcttctcctggctcaagtctgggcaacacggcctccctgacaatctctgggctccaggctgaggacgaggctgattactactgctggctcatatgcnggtctatctcttatgtcttcggaacttgggaccaggtcaccgttcgngttcaagcccgaacggccaacccgactcgttctaacc

SEQ ID NO: 416951 - DNA, 577 bp, Homo sapiens
  misc_feature: GZ8MTXP01D8TFL.19.78.H01.1.454.CMB.2.raw
  modified_base (279)..(279): a, c, t, g, unknown or other
  modified_base (297)..(297): a, c, t, g, unknown or other
  modified_base (445)..(445): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaacatcaaccaaataaacnccccaaatcatcatttangatcgaccaactaacgccggtccctcgtaggggtttactaatcgtcttctcctggtctacaagtctaaggccaacgaccgtccctccctgacaatctcgtcgggctccgaggctaggaggacgaggctgaattactactgctggctanatactgaccgtggttcttattcttctttagtcgttcttaacgggaacgttggggaaccttaaaggtcctaacccgttcgttacggttccaacggccccaaacggaccccaacccgttactcgttcctaaccc

SEQ ID NO: 416952 - DNA, 503 bp, Homo sapiens
  misc_feature: GZ8MTXP01EO2D5.19.78.H01.1.454.CMB.2.raw
  modified_base (319)..(319): a, c, t, g, unknown or other
  modified_base (379)..(379): a, c, t, g, unknown or other
  modified_base (438)..(438): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcaccaaataaagcccccaaactcatcatttatgatgccactaagcggccctnagggtttctaatcgcttctctggctcaagtctaggcaacacggcctccctgacaatctcnggctcgaggctgaggacgaggctagattactactgctggctcatatgcagtcgtatctnttatgtctcggaacttgggaccaaggtcaacgttcgttggcaagcccaagccacccatcgctaac

SEQ ID NO: 416953 - DNA, 514 bp, Homo sapiens
  misc_feature: GZ8MTXP01EJBFG.19.78.H01.1.454.CMB.2.raw
  modified_base (262)..(262): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaanatcacccaaataaagcccccaaatcatcatttatgatgccactaagcgccctcaggggtttctaatcgcttctcctggctccaagtctggcaacacgcctccctgacaatctctgggctccaggctgaggacgaggctgaattactactgctggctcatatgcaggtcgtatctcttatgtcttcggaacttgggaccaaaggtcaccgttcgttaggttcaagcccaaggcccaacccgctcgttctaacc

SEQ ID NO: 416954 - DNA, 561 bp, Homo sapiens
  misc_feature: GZ8MTXP01C5YYY.19.78.H01.1.454.CMB.2.raw
  modified_base (381)..(381): a, c, t, g, unknown or other
  modified_base (387)..(387): a, c, t, g, unknown or other
  modified_base (393)..(393): a, c, t, g, unknown or other
  modified_base (399)..(399): a, c, t, g, unknown or other
  modified_base (408)..(408): a, c, t, g, unknown or other
  modified_base (423)..(423): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctctgcactggaacagcagtgatgttagaaattctaacttgtctctggtaccaacatacaacccaaaataaacgcccccaaaactcatcatttatgatgaccaactaagcgccctacaggggtttactaatcgtcttctctggctccaaagtctaggacaacacggcctaccctanacatcncgtgcncagcgngagacgagntagtatactactgtntcgtctatatatgtcgtacgtacgttacttcttacttagttcgttcgttaacggtaacgttacggtaacgaacgtacgtaccgttaccgttacgttacgaacgaccgaaccgaacccaacccacctaacgttccgtcc

SEQ ID NO: 416955 - DNA, 512 bp, Homo sapiens
  misc_feature: GZ8MTXP01DN4N8.19.78.H01.1.454.CMB.2.raw
  modified_base (427)..(427): a, c, t, g, unknown or other
  modified_base (506)..(506): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataaagcccccaaaactcatcatttatgatgaccactaagcggccctcagggggtttctaatcgcttctcctggctccaagtctgggcaacacggccctccctgacaatctctgggctccaggctgaggacgaggctgattactactgctggctnatatgcaggtctatctcttatgtcttcggaacttgggaccaaggtcacgttcgttaggttcaagccaaggccaaccccntcgctc

SEQ ID NO: 416956 - DNA, 519 bp, Homo sapiens
  misc_feature: GZ8MTXP01AILTH.19.78.H01.1.454.CMB.2.raw
  modified_base (510)..(510): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgccccccaaactcatcatttatgatgccactaagcggccctctagggggtttctaatcgcttctcctggctccaagtctaggcaacacggcctccctgacaatctctgggctccaggctgaggacgaggctgattactactgctggcttcatatgcaggtctatctcttatgtcttcggaacttgggaccaaggtcaccgttcttaggcaagcccaaggccaacccnctcgctaac

SEQ ID NO: 416957 - DNA, 524 bp, Homo sapiens
  misc_feature: GZ8MTXP01B703A.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtacaacatcacccaaataaagcccccaaactcatcatttatgatgccactaagcggcccctcagggggtttctaatcgcttctcctggctccaagtctaggcaacacggcctccctgacaatctctgggctcaggctgaggacgaggctgattactactgctggctcatatgcaggtcgtatcttcttatgtcttcggaacttggggaaccaagggtctaccgttccgttagggttccaagcccaaggcccaacccactgttctaacc

SEQ ID NO: 416958 - DNA, 510 bp, Homo sapiens
  misc_feature: GZ8MTXP01AY236.19.78.H01.1.454.CMB.2.raw
  modified_base (480)..(480): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataaacgccccaaactcatcatttatgatgccactaagcggccctcgtaggggtttctaatcgcttctcctggctccaagtctaggacaacacggcctccctgacaatctctgggctccgaggctgaggacgagctgattactactgctggctctatatgcaggtctatctcttatcgtctcgaagttggaccaaggtccacgttcgngttcaacgcccaaggcccaccactcgctcc

SEQ ID NO: 416959 - DNA, 514 bp, Homo sapiens
  misc_feature: GZ8MTXP01BK6AM.19.78.H01.1.454.CMB.2.raw
  modified_base (386)..(386): a, c, t, g, unknown or other
  modified_base (434)..(434): a, c, t, g, unknown or other
  modified_base (454)..(454): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcaacccaaataaacgcccccaaactcatacatttatgatgaccaactaacgcgccctacgtagggggtttactaatcgcttctcctggctcaagtctaggacaacgacgcctccctgacaatcnctggctcgagctacgagacgaggctagattacacttgctggctcatangcaggtctatctctatcgtntcggaacttgggaccaaaggtcacgttcgttggccaagcccaagcccaccactcgctaac

SEQ ID NO: 416960 - DNA, 557 bp, Homo sapiens
  misc_feature: GZ8MTXP01DGV2L.19.78.H01.1.454.CMB.2.raw
  modified_base (431)..(431): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaacccaaataaacgacccccaaactcatcatttatgatgccactaagccgccctcgagggtttctaatcgcttctcctggctccaagtctaggcaacgacgccctccctgacaatctctgggctccaggctgaggacgaggctgattactactgctggctcatangcgaggtcttatctcttagtcgttcgttaacggaacgttcgggaacccaagggttccctaccggttccgttacggttccgaacgaccccgaaacggaccccctaacccgacttcgttcctaacccg

SEQ ID NO: 416961 - DNA, 509 bp, Homo sapiens
  misc_feature: GZ8MTXP01EULA2.19.78.H01.1.454.CMB.2.raw
  modified_base (275)..(275): a, c, t, g, unknown or other
  modified_base (299)..(299): a, c, t, g, unknown or other
  modified_base (313)..(313): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacacatcaccaaataaancccccaaactcatcatttatgatncactaagcgccctntaggggtttctaatcgcttctcctggctccaagtctaggcaacacggcctccctgacaatctctgggctccgaggctgaggacgaggctgattactatgcctggcttcatagtgcaggtctatctcttatgtctcggaattggaccaaggtctacgttcgttggttcaagcccaagccacccacgtcgttctaacc

SEQ ID NO: 416962 - DNA, 546 bp, Homo sapiens
  misc_feature: GZ8MTXP01DOZ3J.19.78.H01.1.454.CMB.2.raw
  modified_base (276)..(276): a, c, t, g, unknown or other
  modified_base (369)..(369): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcacccaaataaancccccaaactcatcatttatgatgaccactaagcgccctcaggggtttctaatcgcttctcctggctcaagtctcggcaacacggccctcccngacatctctgggctccgaggctgaggacgaggctgattactactgctgctcatatgcaggtcgtatcttcttatgttcgttaacggaacgttggggaacccttaaagggtcctaccgttccgttacggttaccaaccgacccgaacggccccaaccccgacttcgttccttaacccg

SEQ ID NO: 416963 - DNA, 540 bp, Homo sapiens
  misc_feature: GZ8MTXP01C4DM1.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcacccaaataaacgcccccaaactcatcatttatgatgccactaagcggccctcaggggtttctaatcgcttctcctggctcaagtctaggcaacacgccctccctgacatctctggctcagctgaggacgaggctgattactactgcctggctcattatgcctaggtcgtatcttcttatcgttcttcggaacttggggaacccaaagggtccaccgttccgaggttccaacgaccccgaacggccccaaaccccttacttcgccttaacccg

SEQ ID NO: 416964 - DNA, 511 bp, Homo sapiens
  misc_feature: GZ8MTXP01EEVKN.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcacccaaataaacgccccaaactcatcatttatgatgccactaaagcggcccctcagggggtttctaaatcgcttctcctggctccaagtctaggcaacacggcctccctgacaatctctgggctcaggctgaggacgagctgattacatgctggcttcatatgcagtcgtatctcttatgtctggaacttgggaccaaggtcacgttcttaggttcaagcccaagcccacccatcgttctaacc

SEQ ID NO: 416965 - DNA, 514 bp, Homo sapiens
  misc_feature: GZ8MTXP01BHOZP.19.78.H01.1.454.CMB.2.raw
  modified_base (266)..(266): a, c, t, g, unknown or other
  modified_base (398)..(398): a, c, t, g, unknown or other
  modified_base (423)..(423): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaanatcaccaaataaagccccaaactcatcatttatgatgccataagcggccctcaggggtttctaatcgcttctctggctccaagtctggcaacacggcctccctgacaatctctgggctccagctgaggacgnggctgattactactgctggctcatntgcagatcgtatcttcttatgtcttcggactcgggactaaggtcaccgttcttaggtcacgcccaacggcccaaacccgtcttcgtaaccc

SEQ ID NO: 416966 - DNA, 518 bp, Homo sapiens
  misc_feature: GZ8MTXP01ACXJD.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctggtaccaacatcacccaaataaacgcccccaaactcatcatttatgatgccactaagcgccctcagggtttctaatcgcttctctggctcaagtctggcaacacggccctccctgacaatctctgggctccaggctggagacgaggctgattactactgctggctcatatgctaggtctatctcttatgtcgttcggaacttggggaccaaggtccaccgttcgttggttcaagcccaacggcccaaccactcgctaacc

SEQ ID NO: 416967 - DNA, 582 bp, Homo sapiens
  misc_feature: GZ8MTXP01EUDFL.19.78.H01.1.454.CMB.2.raw
  modified_base (265)..(265): a, c, t, g, unknown or other
  modified_base (281)..(281): a, c, t, g, unknown or other
  modified_base (297)..(297): a, c, t, g, unknown or other
  modified_base (385)..(385): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcattggaaccagcagtgatgttagaaattctaacttgtctctgtacanatcaaccaaataaacncccaaatcatcattangatgacactaacgcgtccctactagggttactaatcgtcttctcctggctacaagtctaggacaacacggcctcccagacaatctcgnggctcgaggctagaggacgaggtctagaacttacgtaacgtgccttcgtactatatacgtacgacgttacggttacttacttcttacgttacgttcgttacgtaacggtaacgttacggtaaccgttacggtccgtaccgttaccgttacgttaccaaccgacccgaaccgaccctaaccttactccgttaacctcc

SEQ ID NO: 416968 - DNA, 510 bp, Homo sapiens
  misc_feature: GZ8MTXP01D9L7H.19.78.H01.1.454.CMB.2.raw
  modified_base (266)..(266): a, c, t, g, unknown or other
  modified_base (419)..(419): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaanatcacccaaataaagccccaaactcatcatttatgatgccactaagcgccctcaggggtttctaatcgcttctcctggctccaagtctgcaacacgcctccctgacaatctctggctcagctgagacgagctgattacactgctggctcatangcaggtctatctcttatgtctcggaacttgggaccaaaggtcaacgttccgttaggttcaacgcccaaggcccaacccactcgttctaacc

SEQ ID NO: 416969 - DNA, 546 bp, Homo sapiens
  misc_feature: GZ8MTXP01BO1OE.19.78.H01.1.454.CMB.2.raw
  modified_base (457)..(457): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataacgccccaaactcatcatttatgatgccactaagcggccctcaggggtttctaatcgcttctctggctccaagtctggcaacacggcctccctgacaatcctctgggctccaggcctgaaggacgaagggcctgattactactgctgctcatatgctaggtctatctcttatgttcttcggggaacttgggaccaaggtcaaccgtctaggtaccncgacccaaggcccaacccgctcgttccacttcgtcgttccccgcccttccttacccaacgacgaacgtactggacgtccgggcgtcggg

SEQ ID NO: 416970 - DNA, 499 bp, Homo sapiens
  misc_feature: GZ8MTXP01DBUED.19.78.H01.1.454.CMB.2.raw
  modified_base (314)..(314): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtacaacatcaccaaataaagccccaaactcatcatttatgatgccataagcggccctnagggggtttctaatcgcttctctggctccaagtctggcaacacggcctccctgacaatctctgggctccagctgaggacgagctgattacactgctggctcatatgcaggtcgtatctcttatgtcttcggaacttgggaccaaggtcaccgttcttgttcaagcccaaggccacccatgctaac

SEQ ID NO: 416971 - DNA, 547 bp, Homo sapiens
  misc_feature: GZ8MTXP01EFTRA.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataaacgccccaaactcatcatttatgatgaccactaagcgccctcgtaggggtttctaatcgcttctcctggctccaagtctaggcaacgacgccctccctgacaatctcgtggctccgaggctgaggacgaggctgattactactgctggctcatatgcgagttcgtatcttctttatcgtcttaacggaacttggggaaccttaagggtcctacccgttccgttaggttccaacgccccaacggccccaaccccgttactcgttcctaacccg

SEQ ID NO: 416972 - DNA, 502 bp, Homo sapiens
  misc_feature: GZ8MTXP01DUSDS.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataaacgccccaaactcatcatttatgatgcactaagcgccctcaggggtttctaatcgcttctcctggctccaagtctgggcaacacggcctccctgacaatctctgggctccaggctgaggacgaggctgattacactgctggctcatatgctaggtctatctcttatgtcttcggaacttgggacaaggtcacgttcgttgcaagcccaaggccaacccacgtcgctaacc

SEQ ID NO: 416973 - DNA, 579 bp, Homo sapiens
  misc_feature: GZ8MTXP01DFH9G.19.78.H01.1.454.CMB.2.raw
  modified_base (198)..(198): a, c, t, g, unknown or other
  modified_base (263)..(263): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgtagaaattctaactgtctctgtacaanatcaccaaataaacgccccaaactcatcatttatgatgccaactaagccggccctcgagggggtttctaatccgcttctcctggctccaagtcgtaggacaacgacggccctccctgacaatctcgtggctccaggctggaggacgaggctgattacactgctgggtctctaaatgtgccgtaagggttctaattcgtctttaatcggttcgttaacgggaaacgttggggaaacccagggttcctaacccggttcgttacggttacaacggaccccaacgggaccccaaccccttacgttcgttccgttaacccg

SEQ ID NO: 416974 - DNA, 517 bp, Homo sapiens
  misc_feature: GZ8MTXP01AC5TT.19.78.H01.1.454.CMB.2.raw
  modified_base (437)..(437): a, c, t, g, unknown or other
  modified_base (507)..(507): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcacccaaataaacgcccccaaactcatcatttatgatgccactaagcggccctcgaggggtttctaatcgcttctcctggctcaagtctaggcaacacggccctcctgacatctctggctcagctgagacgaggctgattacgactgctggctcatactgcaggtctaatntctcttatgtcttcggaacttcggggaccaagggtccaccgttcaggtccacgcccaaaggcccaacccnttcgtaaccc

SEQ ID NO: 416975 - DNA, 555 bp, Homo sapiens
  misc_feature: GZ8MTXP01B0MSE.19.78.H01.1.454.CMB.2.raw
  modified_base (263)..(263): a, c, t, g, unknown or other
  modified_base (297)..(297): a, c, t, g, unknown or other
  modified_base (315)..(315): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctggtaccaanatcacccaaataaacgccccaaatcatcatttangatgccataagcgccctnagggtttcaatcgcttctctggctcaagtctggcaacacggcctccctgactaatcactgggctccgaggcctgaggacgaggctgacttacactgctggctcatatgcaggtcattactctacttatgttaacgtacggaacgttcgggaacctaaagggtcccttaccggttcccttaaacggggttccaacgccccgtaaacgggtccccaaaacccccgtcgttccggttaacccc

SEQ ID NO: 416976 - DNA, 524 bp, Homo sapiens
  misc_feature: GZ8MTXP01AEXVR.19.78.H01.1.454.CMB.2.raw
  modified_base (227)..(227): a, c, t, g, unknown or other
  modified_base (440)..(440): a, c, t, g, unknown or other
  modified_base (451)..(451): a, c, t, g, unknown or other
  modified_base (514)..(514): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaacttgtctctgtaccaacatcacccaaataaacgccccaaactcatcatttatgatgccactaagcggccctcgagggggtttctaatcgcttctcctggctccaagtctggacaacgacggccctccctgacaatctctgggctccgagctgacggacgaggctgattactactgctggctcatagtgcgnggtcgtatctnttatgtcttcggaacttgggaccaggtccaccgttcgttgttcaagcccaacggcccaacccntcgctaaccc

SEQ ID NO: 416977 - DNA, 498 bp, Homo sapiens
  misc_feature: GZ8MTXP01DKRMV.19.78.H01.1.454.CMB.2.raw
  modified_base (260)..(260): a, c, t, g, unknown or other
  modified_base (437)..(437): a, c, t, g, unknown or other
  modified_base (441)..(441): a, c, t, g, unknown or other
  modified_base (464)..(464): a, c, t, g, unknown or other
  modified_base (492)..(492): a, c, t, g, unknown or other
  modified_base (497)..(497): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaanatcacccaaataaagccccaaactcatcatttatgatgccactaagcggccctcgagggggttttcaatcgcttctcctggctccaagtctggcaacacggcctccctgacaatctctgggctccaggctgaggacgaggctgattactactgctggctcatatgcaggtctatctnttangtcttgaacttgggaccaggtcncgttcttggcaagcccaaggccaacccntcgcnc

SEQ ID NO: 416978 - DNA, 512 bp, Homo sapiens
  misc_feature: GZ8MTXP01A69K9.19.78.H01.1.454.CMB.2.raw
  modified_base (502)..(502): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacaacatcaccaaataaacgccccaaatcatcatttatgatgccactaagcgccctgtaggggtttcaatcgcttctcctggctcaagtctaggcaacacgcctcctgacaatctctgggctccaggctgaggacgaggtctgattactactgcctggctcatatgcaggtctatctcttatcgtcttcggaacttgggaccaggtcaccgttcgttggttccaagcccaaggcccaacccnctcgctaacc

SEQ ID NO: 416979 - DNA, 556 bp, Homo sapiens
  misc_feature: GZ8MTXP01E0MVD.19.78.H01.1.454.CMB.2.raw
  modified_base (264)..(264): a, c, t, g, unknown or other
  modified_base (300)..(300): a, c, t, g, unknown or other
tcagtactctcgtgcacgaccggtgctcgatttagtgtgagtagtttgggtttgggtgtcacaagaggcagcgctctcgggacgtctccaccatggcctgggctctgctgctcctcactctcctcactcaggcacagggtcctgggcccagtctgccctgactcagtctgcctccgtgtctgggtctcctggacagtcggtcaccatctcctgcactggaaccagcagtgatgttggaaattctaacttgtctctggtaccaanatcacccaaataaacgcccccaaactcatcatttangatgaccactaagccggccctcgtaggggtttctaatcgtcttcctctggctcaagtctggcaacacgcctcctgacatctctggctcgagctgaggacgagctagacttactactgctgctcatatgcgtaggttcgtacttcttcttagttcgttcgttacggaaacgtcggggaacccgtaaagggttcccacccggttccgttacggtccgacgaaccccgaacggccccaacccctaacgttcgtaacccc

SEQ ID NO: 416980 - DNA, 514 bp, Homo sapiens
  misc_feature: GZ8MTXP01EVQYV.19.78.H01.1.454.CMB.2.raw
  modified_base (504)..(504): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcacccaaataaagcccccaaatcatcatttatgatgccactaagcggccctcgagggggtttctaatcgcttctcctggctccaagtctggcaacacggcctccctgacaatctctgggctccaggctgaggacgaggctgattctactgctggctcatatgcagttcgtattcgtcttatgtcttcggaacttgggacaaggtccacgttcgttaggcaagcccaaggcccaacccgntcgttctaac

SEQ ID NO: 416981 - DNA, 566 bp, Homo sapiens
  misc_feature: GZ8MTXP01AW8NH.19.78.H01.1.454.CMB.2.raw
  modified_base (264)..(264): a, c, t, g, unknown or other
  modified_base (297)..(297): a, c, t, g, unknown or other
  modified_base (412)..(412): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacntcaccaaataaacgccccaaactcatcatttangatgccataagcggccctcgtaggggtttctaatcgcttctcctggctccaagtctacggacaacgaccggtcctccctagacaactctacgtgggctccgaggctggaggacgngctgattactactgctggctacatagtcgcaggttctatcttcttatcgtcgttaacggaacgttcgggaaccttaacgggtcctacccgttacgttggttaccaacggaccccgtaacggaccccaaccccgttactccgttccttaaccccg

SEQ ID NO: 416982 - DNA, 579 bp, Homo sapiens
  misc_feature: GZ8MTXP01DXD60.19.78.H01.1.454.CMB.2.raw
  modified_base (264)..(264): a, c, t, g, unknown or other
  modified_base (300)..(300): a, c, t, g, unknown or other
  modified_base (424)..(424): a, c, t, g, unknown or other
  modified_base (561)..(561): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggatacagggtcctgggcccagtctgccctgactcagtctgcctccgtgtctgggtctcctggacagtcggtcaccatctcctgcactggaaccagcagtgatgttgaaattctaactgtctctgtaccaanatcaaccaaataaacgccccaaactcatcaatttangatgaccactagcgccctcgagggtttctaatcgcttctctggctcaagtctaggcaacacgcctccctgacaatctctggctcaggctgaggacgaggctgacttactacgtgcctggcctanattagtcgacgtacgggttcttaacttcttctttaagttcgttccgtttaacgggaaacgttcgggggaacccttaaacggggttccaaccggttccgttagggttacccaacggacccgaacggacccaaaccccncgttcgttccttaacccg

SEQ ID NO: 416983 - DNA, 523 bp, Homo sapiens
  misc_feature: GZ8MTXP01AMI71.19.78.H01.1.454.CMB.2.raw
  modified_base (319)..(319): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtacaacatcaccaaataaagccccaaactcatcatttatgatgccactaagcggccctntaggggtttctaatcgcttctcctggctcaagtctaggcaacacggcctccctgacaatctctgggctccaggctgaggacgaggctgattacactgctggcttcattatgcaggtcttatctcttatcgtcgttcggaacgttgggaccaaggtccaaccgttcgcgttccaagcccaacggcccaacccgactcgcctaacc

SEQ ID NO: 416984 - DNA, 557 bp, Homo sapiens
  misc_feature: GZ8MTXP01D1HT3.19.78.H01.1.454.CMB.2.raw
  modified_base (297)..(297): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcaccaaataaagccccaaatcatcatttangatgccactaagcgccctcaggggtttctaatcgcttctctggctccaagtctagcaacacgcctcctgacaatctctggctccaggctaggaggacgagctagtattactagtgtctggctactatagtcgcgtaggttacttatcttactttagtcgttcgttaacggaacgttacgggaaccgttaaggtccctaaccgttccgttaggttaccaacgacccgaacggccccaaacccttacgtcgttaacctcccg

SEQ ID NO: 416985 - DNA, 503 bp, Homo sapiens
  misc_feature: GZ8MTXP01DPWMO.19.78.H01.1.454.CMB.2.raw
  modified_base (284)..(284): a, c, t, g, unknown or other
  modified_base (302)..(303): a, c, t, g, unknown or other
  modified_base (305)..(306): a, c, t, g, unknown or other
  modified_base (324)..(324): a, c, t, g, unknown or other
  modified_base (336)..(336): a, c, t, g, unknown or other
  modified_base (376)..(376): a, c, t, g, unknown or other
  modified_base (405)..(405): a, c, t, g, unknown or other
  modified_base (413)..(413): a, c, t, g, unknown or other
  modified_base (420)..(420): a, c, t, g, unknown or other
  modified_base (434)..(434): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcagtgatgttagaaattctaacttgtctctgtacaacatcaacccaaaataaacncccaaaatcatcatttannannacacacgcgctcgtagtntatctctctctnctacatcacgacaacacgcctcctacacactctcgtcgcncacgcgagaggggagagatatatactatnctcgtctntatatgngtagtacgtatctntatcgtgtaacgtacgacgacgacgtacgtacgttcgttcgacaacacgaacgaccaccactcgttctc

SEQ ID NO: 416986 - DNA, 542 bp, Homo sapiens
  misc_feature: GZ8MTXP01DIUEJ.19.78.H01.1.454.CMB.2.raw
  modified_base (397)..(397): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcaccaaataaacgcccccaaactcatcatttatgatgccactaagcgccctcgaggggtttctaatcgcttctctggctcaagtctggacaacacggccctccctgacaatctctgggctccaggctgaggacgnggctgattactactgcctgggtctctatatgacgtacggtcgttaactcttctttatcgttcttaacggaacgttcgggaaccaagggttccacgttccgttaggttcaacgacccaacggcccaacccttactcgttctaaccc

SEQ ID NO: 416987 - DNA, 506 bp, Homo sapiens
  misc_feature: GZ8MTXP01C821B.19.78.H01.1.454.CMB.2.raw
  modified_base (469)..(469): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctggtaccaacatcacccaaataaagcccccaaactcatcatttatgatgccactaagcggccctcagggggtttctaatcgcttctcctggctcaagtctaggcaacaccggcctccctgacaatctctgggctccaggctgaggacgaggctgattacactgctggctcatatgcaggtctatctcttatgtcttcggaaattgggacaaggtcncgttcttggttcaagcccaagcccacccactgctaac

SEQ ID NO: 416988 - DNA, 538 bp, Homo sapiens
  misc_feature: GZ8MTXP01A2C3F.19.78.H01.1.454.CMB.2.raw
  modified_base (359)..(359): a, c, t, g, unknown or other
  modified_base (422)..(422): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagccccaaactcatcatttatgatgccactaagcgccctcaggggtttctaatcgcttctcctggctccaagtctaggcaacncggcctccctgacaatctctgggctccaggctgagacgaggctagattacactgcttggctanatagtgcgtagtctatcttcttagtcgttcgttaacggaacgttcgggaaccttaacggtcctaaccgttcgttacgccaacgacccgaacgaccccaacccgcgtcgttcctccg

SEQ ID NO: 416989 - DNA, 530 bp, Homo sapiens
  misc_feature: GZ8MTXP01CS44D.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcacccaaataaagcccccaaactcatcatttatgatgccactaagcggccctcagggggtttctaatcgcttctcctggctcaagtctggcaacacggcctccctgacaatctctgggctccaggctgaggacgaggctgattactactgctggctctatactgcaggttcgtatctcttatgttcttcggaacttgggaaccaaggtccacccgttcgttcggttcaacgacccaacggcccaaccccactcgttctaacccg

SEQ ID NO: 416990 - DNA, 529 bp, Homo sapiens
  misc_feature: GZ8MTXP01DHLEO.19.78.H01.1.454.CMB.2.raw
  modified_base (516)..(516): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcacccaaataaagcccccaaactcatcatttatgatgccactaaagcggccctcagggggtttctaatcgcttctcctggctccaagtctacgggcaacacggccctccctgacaatctctgggctccaggctgaggacgaggctgattacactgcttggctcatatgcaggtcgtatctcttatgtcttcgaacttgggaccaaggtcaccgttcgttcgttcaacgacccaacggcccaacccnctcgttctaaccc

SEQ ID NO: 416991 - DNA, 587 bp, Homo sapiens
  misc_feature: GZ8MTXP01AHPAG.19.78.H01.1.454.CMB.2.raw
  modified_base (544)..(544): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaaccaaataaacgccccaaatcatcatttatgatgccactaagcgcctcagggtttctaatcgcttctctggctcaagtctggcaacacggcctcctgacaatcctctgggctccaggctggaaggacgaggctgattactactgctgctcatactgacgaggtctatcttcttaattcgtcgtttacggggaacgtacggggaaccaaagggttcccaccggttccgtaggtaccaacggaccccgaaacgggccccaaaccccgtaactcgttaccaccttccttccgttacccccacccgttcccnccctaacgagtaacgttaccggtcggacggtcgggttcgtcgg

SEQ ID NO: 416992 - DNA, 496 bp, Homo sapiens
  misc_feature: GZ8MTXP01A4ZQF.19.78.H01.1.454.CMB.2.raw
  modified_base (262)..(262): a, c, t, g, unknown or other
  modified_base (278)..(278): a, c, t, g, unknown or other
  modified_base (445)..(445): a, c, t, g, unknown or other
  modified_base (465)..(465): a, c, t, g, unknown or other
  modified_base (474)..(474): a, c, t, g, unknown or other
  modified_base (488)..(488): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaanatcacccaaataaacnccccaaactcatcatttatgatgccactaagccggccctcgtagggggtttctaatcgcttctcctggctccaagtctggcaacacggccctccctgacaatctctgggctccgaggctgaggacgaggctgattactactgctggctcatatgcaggtctatcttntatgtctgacttggacagcncgcgttgcngccaacgccacccnctcgctcc

SEQ ID NO: 416993 - DNA, 536 bp, Homo sapiens
  misc_feature: GZ8MTXP01DYXF8.19.78.H01.1.454.CMB.2.raw
  modified_base (231)..(231): a, c, t, g, unknown or other
  modified_base (265)..(265): a, c, t, g, unknown or other
  modified_base (344)..(344): a, c, t, g, unknown or other
  modified_base (359)..(359): a, c, t, g, unknown or other
  modified_base (531)..(531): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctgtaccaanatcaaccaaataaacgccccaaatcatcatttangatgccactaagcggccctcgaggggtttctaatcgcttctctggctcaagtctggcaacacggcctccctgacatccnctggctccaggctgnggacgagctgacttactactgctgctcatactgcagggttctatcttcgttatgttcttacggggaacttggggaccaaggtccaccgttctaggtcacgcccaaggcccaaccccgaatcgttcacttctcgtccccaccttccttaccgaacagcgtactggagtccggntcggg

SEQ ID NO: 416994 - DNA, 573 bp, Homo sapiens
  misc_feature: GZ8MTXP01ERJHA.19.78.H01.1.454.CMB.2.raw
  modified_base (300)..(300): a, c, t, g, unknown or other
  modified_base (459)..(459): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctgtacaacatacaccaaataaacgaccccaaactcatctatttangatcgcactaagcggccctcgtagggtttactaatcgcttctcctggctccaagtctcgggacaacgaccggccctccctagactaatctcgtcgggctccgaggctggaggacgagtctgattactactgctggctcatagtgcagggttctatcttntttatcgttcgttcggaacgttcgggaaccttaacgggttccgaacccgttccgttacgggttccaacggcccctaaacgggccccaaccccttacgttcgttaacctaacccg

SEQ ID NO: 416995 - DNA, 504 bp, Homo sapiens
  misc_feature: GZ8MTXP01B59TS.19.78.H01.1.454.CMB.2.raw
  modified_base (256)..(256): a, c, t, g, unknown or other
  modified_base (265)..(265): a, c, t, g, unknown or other
  modified_base (280)..(280): a, c, t, g, unknown or other
  modified_base (416)..(416): a, c, t, g, unknown or other
  modified_base (476)..(476): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtcnctgtacaanatcaccaaataaacncccccaaactcatcattatgatgccactaagcgccctctaggggtttctaatcgcttctcctggctccaagtctaggcaacacggcctccctgacaatctctggctccaggctggagacgaggctgattactactnactggctcatagtcgcaggtctatcttctatgtctcggaattgggaccaggtcacgttcngttcaacgccaagccaccactcgttctc

SEQ ID NO: 416996 - DNA, 521 bp, Homo sapiens
  misc_feature: GZ8MTXP01EK208.19.78.H01.1.454.CMB.2.raw
  modified_base (443)..(443): a, c, t, g, unknown or other
  modified_base (508)..(508): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtaggtcaccatctcctgcactggaaccagcagtgatgttagaaattctaacttgtctctggtacaacatcaccaaataaacgccccaaactcatcatttatgatgccactaagcggcccctcagggggtttctaatcgcttctcctggctcaagtctggcaacacggcctccctgacaatctctgggctccaggctgaggacgagctgattacactgctggctcatatgcaggtctatctcttatntcgttaacggtaacttgggaccaaggtcaccgttcttgggttcaacgacccaaggccccaacccnctcgttctaaccc

SEQ ID NO: 416997 - DNA, 542 bp, Homo sapiens
  misc_feature: GZ8MTXP01BG46M.19.78.H01.1.454.CMB.2.raw
  modified_base (360)..(360): a, c, t, g, unknown or other
  modified_base (498)..(498): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgccccaaactcatcattatgatgccactaagcgccctcaggggttctaatcgcttctctggctcaagtctggcaacacggcctccctgacaatcctctggctccaggctgnggacgaggctgattactactgctgctcatatgacgaggttcgtattctcttatgttcttacggggaactgggaccaaggtcacccgtctaggtcacgcccgaaggcccaacccgaactcgcaccttcgtcgttccccncccgttccttaccaacgactaacgtactgacgcggcgtaacggg

SEQ ID NO: 416998 - DNA, 575 bp, Homo sapiens
  misc_feature: GZ8MTXP01B79XV.19.78.H01.1.454.CMB.2.raw
  modified_base (225)..(225): a, c, t, g, unknown or other
  modified_base (277)..(277): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattccaacttgtctctgtacacatcaccaaataaacnccccaaatcatcatttatgatgaccactaagcgccctgtagggtttactaatcgcttctcctggctccaagtctaggaccaacgacggccctaccctagacaatctcgtcgggctccgaggctaggacggacgaggctagaacttactactgctgggcttcatacgtgcgtaggttctaattcttcttatcgttcgttaacggaacttcgggaaaccttaagggtccaccggttaccgttacggaccaacggaccccgaacggcccctaaaccccgttcgtaaccgttccgtaacccg

SEQ ID NO: 416999 - DNA, 524 bp, Homo sapiens
  misc_feature: GZ8MTXP01BWG57.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacaacatcacccaaataaagcccccaaactcatcatttatgatgccactaagcggccctcagggggtttctaatcgcttctcctggctccaagtctagggcaacacggccctccctgacaatctctgggctccaggctgaggacgaggctgattactactgctggctcatatgcaggtcgtatcttcttatgtcttaacggaacttggggaccaggtcaaccgttcgttggttcaagtcccaacggcccacccactcgctaacc

SEQ ID NO: 417000 - DNA, 610 bp, Homo sapiens
  misc_feature: GZ8MTXP01EP98D.19.78.H01.1.454.CMB.2.raw
  modified_base (498)..(498): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaacatacaaccaaataaacgaccccaaactcatctattatgatcgaccaactaacgccggtcccgtacgtaggggtttctaatcgtcttctcctcggtctaccaagtctacgggacaacgaccggccctccctacgacctaactctcgtcgggcctccgaggcgtaggaggaacgaggtactagtaacttacctactcgtcttcggcttacaattagtgacgtaggttctaattcttnttattcgttcgttaacggtaacgttcgggaaccgttaaacggtccaccgttaccgttcgttaccaaccgacccgaacggaccccaacccttacgtaaccgttccgttaaccc

SEQ ID NO: 417001 - DNA, 524 bp, Homo sapiens
  misc_feature: GZ8MTXP01CKDSD.19.78.H01.1.454.CMB.2.raw
  modified_base (299)..(299): a, c, t, g, unknown or other
  modified_base (464)..(464): a, c, t, g, unknown or other
  modified_base (515)..(515): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgttagaaattctaacttgtctctgtacaacatcaacccaaataaacgacccccaaactcatcatttangatgccactaagccgcctcgagggtttctaatcgcttctcctggctcaagtctaggacaacgaccggcctaccctgacaaactctcgtcgggctccaaggtctaggacggacgagggctagattactactgctggctcatatgctaggtctatctcttatcgttntaacggacttgggacaggtccacgttcgttgcaagcccaacgcccaacccntcgctaacc

SEQ ID NO: 417002 - DNA, 620 bp, Homo sapiens
  misc_feature: GZ8MTXP01A4XGI.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctggtacaacatacaaccaaataacaccccaaactcatacatttatgatacgaccaactaaacgccggccctacgtacggggtttactaaatcgctttctcctcggctacctaagtctacggacaacgaccggccctacctcgaactactctcgtcgggtctccgaggtctaggaggacgaggtctgtaattacgtactgctcggtctcgtatacgtgccgtaggtcgttacttcttcttatcgttcttaacgggtaacttacgggaacccgttaaggtacccgtaacccgttaccgttacgggaccaaacccggcccgaaaccggttaccccaacccccgttaacgttccgttccgttaacccg

SEQ ID NO: 417003 - DNA, 676 bp, Homo sapiens
  misc_feature: GZ8MTXP01EBK0Z.19.78.H01.1.454.CMB.2.raw
  modified_base (222)..(222): a, c, t, g, unknown or other
  modified_base (298)..(298): a, c, t, g, unknown or other
  modified_base (317)..(317): a, c, t, g, unknown or other
  modified_base (364)..(364): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccngcagtgatgttagaaattctaacttgtctctgtaccaacatacaaccaaataaacgaccccaaactcatcatttangatgccaataagcgccctntagggtttctaatcgcttctcctggctccaagtctagggacctaacnccggccctccctagaaccaacttctcgtcgggccttccgaaggccgtaggaagggaaccgagggtacctaggaactttaccgtaacctggccttaggcttactaattaagttcggacgtacgggttcttaaacttcttacctttaattccggttaccgttaacgggtaaacgttcggggaaacccgttaaacgggttacccgtaacccggttacccggttaacggttaccccgtaaaccgggtacccccgtaaaacccggggtaacccccaaaaccccccgttaacttcccgggttaaccctttaaccccgg

SEQ ID NO: 417004 - DNA, 585 bp, Homo sapiens
  misc_feature: GZ8MTXP01CA2PI.19.78.H01.1.454.CMB.2.raw
  modified_base (294)..(295): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgcacatctcctgcacgtggaaccagcagtgatgttagaaattctaacttgtctctgtacaacatacaccaaataaacgaccccaaactcatcattannatgccataagcgcctcgagggtttactaatcgcttctcctggctaccaagtctacgaccaacacggactccctagacaatctcgtcgggctccgagctggaggacgaggctagacttactactgtctcgggcttacatagtgccgtaggtcctagttcttcttaattcgtcgttaacggtaaacgttcgggaaacccttaaggtaccgtacccgttaccgttacgggttacccaaccggaccccgaaacggacccccaaaccccttacgttaaccggttccttaaccccg

SEQ ID NO: 417005 - DNA, 543 bp, Homo sapiens
  misc_feature: GZ8MTXP01BEIMH.19.78.H01.1.454.CMB.2.raw
  modified_base (279)..(279): a, c, t, g, unknown or other
  modified_base (298)..(298): a, c, t, g, unknown or other
  modified_base (524)..(524): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtaccaacatcaccaaataaacnccccaaactcatcatttangatgccactaagcggccctcgaggggtttctaatcgcttctcctggctccaagtctggcaacacggccctccctgacaatctcgtggctccgaggctgaggacgagctgattactactgctggctcatatgcaggtcgtactctcgttatgtcttggaaacttcggggaccttaacgggtcctaccgttccgttggttccaacggccccaaacggccccaaccccncttaacgttccgtaacccg

SEQ ID NO: 417006 - DNA, 575 bp, Homo sapiens
  misc_feature: GZ8MTXP01AEY4C.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatacacccaaataaacgacccccaaactcatcatttatgatcgccactaacgcggccctcgtagggtttctaatcgcttctcctggctccaagtctaggacaacaccggccctcctagacaatctcgtgggctccaggctaggaggacgaggctagattactactgctggctcatactgctggtctatcttcttatcgtcgttaacgggaacttcggggaacccaaagggtcctaacccggttccgttacggttaccaaccggaccccgaacgggaccccaaaccccttcgttcgttccgtaacccg

SEQ ID NO: 417007 - DNA, 524 bp, Homo sapiens
  misc_feature: GZ8MTXP01C1GFT.19.78.H01.1.454.CMB.2.raw
  modified_base (198)..(198): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgttgaaattctaacttgtctctggtacaacatcaccaaataaacgccccaaactcatcatttatgatgccactaagcggccctcgaggggtttctaatcgcttctcctggctcaagtctaggcaacacgcctccctgacaatctctggctccgagctgagacgaggctagattacactgctggctcatatgcaggtctatcttcttatgtcttcggaacgttggggaaccaaaggttccaccgttccgttaggttcaacgcccaaggccccaacccactcgttctaacc

SEQ ID NO: 417008 - DNA, 509 bp, Homo sapiens
  misc_feature: GZ8MTXP01AN50K.19.78.H01.1.454.CMB.2.raw
  modified_base (475)..(475): a, c, t, g, unknown or other
  modified_base (499)..(499): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctggtaccaacatcacccaaataaagcccccaaactcatcatttatgatgccactaagcgccctcagggggtttctaatcgcttctcctggctccaagtctagggcaacacggcctccctgacaagtctctgggctccaggctgagacgaggctgattacatgctggctcatatgcagtcgtatctcttatgtctggaacttgggaccaggtccacgttcgnggttcaagcccaagtcccaacccnctcgctaacc

SEQ ID NO: 417009 - DNA, 541 bp, Homo sapiens
  misc_feature: GZ8MTXP01D6P4Y.19.78.H01.1.454.CMB.2.raw
  modified_base (412)..(412): a, c, t, g, unknown or other
  modified_base (455)..(455): a, c, t, g, unknown or other
  modified_base (505)..(505): a, c, t, g, unknown or other
  modified_base (528)..(528): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaaccagcagtgatgttagaaattctaacttgtctctggtacaacatcaccaaataaacgccccaaactcatcatttatgatgaccactaaagcggcccttcagggggtttactaatcgtcttctcctggctccaagtctacggacaacaccggcctccctagacaatctctggctccaggctgaggacgngctgattacgtactgctggtctacatatgctgtcgtattcctnttatgtctcgtaacgttcggaacttaggtcctaccgttaccgttggaccncgacccaacggcccaacccgttntcgttcgtaaccc

SEQ ID NO: 417010 - DNA, 521 bp, Homo sapiens
  misc_feature: GZ8MTXP01AEGXF.19.78.H01.1.454.CMB.2.raw
  modified_base (336)..(336): a, c, t, g, unknown or other
  modified_base (366)..(366): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataaacgcccccaaactcatcatttatgatgccactaagcggcccttcgtaggggtttttaancgtcttctctcggctcaagtctggacaacncgcctccctgacatctctgggctcgaggctgaggacgaggctgattacactgctgctcatatgcagtcgtatctcttatgtcttcggaactgggaccaagggttccaccgtcaggttcacgccccaaggccccaacccgacttcgtccaacttcc

SEQ ID NO: 417011 - DNA, 507 bp, Homo sapiens
  misc_feature: GZ8MTXP01EHOVB.19.78.H01.1.454.CMB.2.raw
  modified_base (304)..(304): a, c, t, g, unknown or other
  modified_base (324)..(324): a, c, t, g, unknown or other
  modified_base (429)..(429): a, c, t, g, unknown or other
  modified_base (447)..(447): a, c, t, g, unknown or other
  modified_base (478)..(478): a, c, t, g, unknown or other
  modified_base (500)..(500): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctggtaccaacatcaacccaaataaacgcccccaaactcatcatttangatgccactaagcggccctnaggggttttcaatcgcttctcctggctccaagtctaggcaacgacggcctccctgaccaatctctgggctccaggctggagacgagctgattacactgctggctnatatgcaggtctatcttntatgtctcgacgttggacagtcaccgttcgngcaacgacccaacgcccaaccnctcgctc

SEQ ID NO: 417012 - DNA, 604 bp, Homo sapiens
  misc_feature: GZ8MTXP01CYPXE.19.78.H01.1.454.CMB.2.raw
  modified_base (363)..(363): a, c, t, g, unknown or other
  modified_base (439)..(439): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtaccaacatcaacccaaataaacgcccccaaatcatcatttatgatgccactaacgcgccctgtagggtttctaatcgcttctcctggctctaagtctaggcaacncggccctccctagacaactctctcgggctccgaggctgaacggacgaggctagtattacactgtctggctacaatnagtcgtaaggttcgtaattccttattagttcgttacgttaaccggtaaacgttcggggtaaacccttaaacggttaccgtaacccgttcccgttagggttacccaacggaacccccgaaacgggtccccaaacccccggttactccggttaacccgttaaccccg

SEQ ID NO: 417013 - DNA, 730 bp, Homo sapiens
  misc_feature: GZ8MTXP01BP57Y.19.78.H01.1.454.CMB.2.raw
  modified_base (640)..(640): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacctgtctctgtaccaacatacaaccaaataacgccccaaatcatactatttatgatcgaccaacgtaacgccggtaccctacgtaaggggttttacctaaacgttccgtacctttccgtccgtcgggtacccttaccgtaaaacggttccgttacgggaccctaaacccgtacccgggtccccttacccgtaggaacctaaacgttccccgtcgtcggggccctacccgaggtcgtagggaacggtaacgacggtcctagtaacttaaccgtacgtgtacctgtactactaagtacgtcgtacgtacggttcgtaacttcttacgttaagtcgttaccgttacggggtaaacgttcgggaaaccgtaacggtcccgtaaccggttccgtaaggtaccgacgaccccgtaaacggccccaaacccgtntccgttcctaccttccgtaccgttccccaccccgttcgttacccgaacggtacgtaacgttaccgtgggacggtccgggttcgtaacggg

SEQ ID NO: 417014 - DNA, 609 bp, Homo sapiens
  misc_feature: GZ8MTXP01B8777.19.78.H01.1.454.CMB.2.raw
  modified_base (590)..(590): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaacttgtctcctgtaccaacatcaccaaataacgccccaaatcatcattatgatgccactaagccgcctcgtagggtttctaatcgcttctcgtggctaccaagtctggacaacaccggcctccctgaactaatccctcgtcgggctcccgagggactaggaaggacgagggtctagattactactcgctgctacatagtgacgtaggtctattccttacttagtcgttcctttacgggggaacgtacgggaacctaacgggttcccaaccgtccgtaacgtccgaaccgaccccgaaacggccccaaccccgaacttcgcctaccgttctcccgtttccccaccccgttccttacccgtaacgacgtaacgttacgnggaccgtcggcgtaacggg

SEQ ID NO: 417015 - DNA, 669 bp, Homo sapiens
  misc_feature: GZ8MTXP01DBIX1.19.78.H01.1.454.CMB.2.raw
  modified_base (232)..(232): a, c, t, g, unknown or other
  modified_base (249)..(249): a, c, t, g, unknown or other
  modified_base (268)..(268): a, c, t, g, unknown or other
  modified_base (641)..(641): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctgtaccaanatacaaccaaataaacnccccaaactcatcatttangatgccactaacgcgcctcgtagggtttactaatcgtcttctctggtcctaccgaagtcgtaggaccaaaccgaccggtcccctaccgtacgaacctaacttcccgtccgtcggggcctcccgaaggtctgggaacggacgagggccttagtacttacgtactgctagcttacatatggctaggttctacttcttacttagtcgttacgttcggggaaacgttcggggaactaacgggtcctaacccgtcgtaacggtacccgaacgtaccccgaaacggccccctaaaccccgtaacttacccggttacctaaccttcccgttaccgttaacccccccaccgttccccgaacgtaacggaacgtttaaccgngggaccgggaccggtaacgcggaaccgg

SEQ ID NO: 417016 - DNA, 600 bp, Homo sapiens
  misc_feature: GZ8MTXP01BEU3M.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacgcccccaaatcatcatttatgatgccactaagcgccctcgtaggggtttctaactcgtcttctcctggctccaagtctggaccaacgaccggccctccctgactaatctcgcgggctccgaggcgtgaggacgagggtctaggaacttactactgtctcgggcttacatagtcgccgtaggttcttatcttcgttatcgttcgttaacggaaacgttcggggtaaaccttacgggtcctaaccggttccgttacgggttacccaacggaccccgaaaccgggccccaaaaccccgttcttaaccgttcccgtaaccccg

SEQ ID NO: 417017 - DNA, 520 bp, Homo sapiens
  misc_feature: GZ8MTXP01E5CKO.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaaccttgtctctggtaccaacatcacccaaataaagcccccaaactcatcatttatgatgccactaagcggccctcagggggtttctaatcgcttctcctggctccaagtctggcaacacgcctccctgacaatctctgggctccaggctgaggacgaggctgattactactgctggctcatatgcaggttctatctcttatgtcttcggaacttgggaccaaaggtcacgttccttggttcaagcccaaggcccaacccactcgttctaacc

SEQ ID NO: 417018 - DNA, 519 bp, Homo sapiens
  misc_feature: GZ8MTXP01D888O.19.78.H01.1.454.CMB.2.raw
  modified_base (262)..(262): a, c, t, g, unknown or other
  modified_base (296)..(296): a, c, t, g, unknown or other
  modified_base (368)..(368): a, c, t, g, unknown or other
  modified_base (416)..(416): a, c, t, g, unknown or other
  modified_base (419)..(419): a, c, t, g, unknown or other
  modified_base (429)..(429): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacaanatcaccaaataaacgccccaaactcatcatttangatgaccactaacgcgccctcgtagggtttctaatcgcttctctggctcaagtctaggcaacacgcctcccngacatctctggctcagctgagacgagctgattactatgctgctcatangcnggtctatctnttatcgttcgtaacgaacgttgggaaccttaggtcctaccgttcgttcggttacaacgacccaacggacccacccgactccgctaacccg

SEQ ID NO: 417019 - DNA, 552 bp, Homo sapiens
  misc_feature: GZ8MTXP01AJ4ZJ.19.78.H01.1.454.CMB.2.raw
  modified_base (280)..(280): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcacccaaataacnccccaaactcatcatttatgatgccactaagccggccctcgaggggtttctaatcgtcttctcctggctccaagtctaggacaacacggccctccctgacaactctctggctcgagcgtgaggacgaggctgattactaactgctggtctacgtatagtcgcgaggttcgtaattcttcttatgttccgttcggaacttcggggaaccttagggtcctaccggttcgttacggttcaacgcccaacgacccaacccttctcgttcgtaaccc

SEQ ID NO: 417020 - DNA, 548 bp, Homo sapiens
  misc_feature: GZ8MTXP01AYYWL.19.78.H01.1.454.CMB.2.raw
  modified_base (225)..(225): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaactgtctctgtacacatcaccaaataagccccaaactcatcatttatgatgccactaaagcggccctctagggggtttctaatcgcttctcctggctccaagtctaggcaacacggcctccctgacaatctctgggctcaggctggaggacgagctgattactactgctggctcatatgcaggtcgtatctcttagtcgttcgttaacggaacttcggggaacccttaagggtcctaacccggttccgttacggttaccaacgccccgaaacggccccaaccccgactccgttccgtaacccg

SEQ ID NO: 417021 - DNA, 498 bp, Homo sapiens
  misc_feature: GZ8MTXP01AT6Q2.19.78.H01.1.454.CMB.2.raw
  modified_base (366)..(366): a, c, t, g, unknown or other
  modified_base (435)..(435): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccagcagtgatgttagaaattctaacttgtctctgtacaacatcacccaaataaacgcccccaaactcatcatttatgatgccactaagcggccctctaggggtttctaatcgtcttctctggctcaagtctgcaacacgcctcccngacatctctgggctcgaggctgaggacgaggctgacttacactgcctggctcatatgcagtcgtatctntatgtctcggacttgggacagtcaccgttcttggcaagcccaacgccacccgctcgttctaac

SEQ ID NO: 417022 - DNA, 523 bp, Homo sapiens
  misc_feature: GZ8MTXP01C0QNN.19.78.H01.1.454.CMB.2.raw
  modified_base (368)..(368): a, c, t, g, unknown or other
  modified_base (375)..(375): a, c, t, g, unknown or other
  modified_base (394)..(394): a, c, t, g, unknown or other
  modified_base (435)..(435): a, c, t, g, unknown or other
  modified_base (510)..(510): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaacatcaaccaaataaacgccccaaatcatcatttatgatgaccactaagcgccctgagggtttcaatcgcttctcctggctccaagtctaggcaacgacgccctccngacatcnctggctcagctgaggacgnggctgaacttactatgctggctcatagtgcaggttctaatnttcttatcgttctaacggaacttgggaaccttaggtccaccgttccgttaggcaacgcccgaacgtcccaacccntaacgctaacccg

SEQ ID NO: 417023 - DNA, 578 bp, Homo sapiens
  misc_feature: GZ8MTXP01DGNJR.19.78.H01.1.454.CMB.2.raw
  modified_base (262)..(262): a, c, t, g, unknown or other
  modified_base (376)..(376): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaactgtctctgtacaanatacaacccaaataaacgaccccaaactcatctatttatgatcgaccaactaacgcggcccttcgacggggtttctaatcgtcttctctcggactccaagtctacgggacaacnccggcctccctagacaactctacgtgggctcgaggctgaggacgagctgattacgactgtctggtcttactatagtgcgtacggtcttacttcttactttatggttcttaacaggttaacgtcggaaccgtaaaggtccttaaccggttccttaagggtccaacgtaaccccaacggccccaaccctaacgttcgttaaccc

SEQ ID NO: 417024 - DNA, 553 bp, Homo sapiens
  misc_feature: GZ8MTXP01EXMZP.19.78.H01.1.454.CMB.2.raw
  modified_base (428)..(428): a, c, t, g, unknown or other
  modified_base (538)..(538): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacgacccccaaactcatcatttatgatgccactaagcgccctctacgggggtttactaatcgcttctcctggctcaagtctaggcaacacgcctccctgacaatctctgggctcaggctgaggacgaggctagattactactgctgggctntactatgcaggttcgtatctcttattcgtcttaacggtaacgttcggggaaccaaggtcctaacccgttccgttacggttccgaacgacccgaacggaccccaaaccccnctcgttcctaacccg

SEQ ID NO: 417025 - DNA, 551 bp, Homo sapiens
  misc_feature: GZ8MTXP01C6T10.19.78.H01.1.454.CMB.2.raw
  modified_base (293)..(293): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcaccaaataaacgccccaaatcatcatttangatgccaactaagcggccctcgaggggtttctaatcgcttctctcggctcaagtctaggcaacacgccctccctgacaatctctcgggctccaggctggaggacgaggctgattactactgctggctctatatgcgtaggtcttactcttctttagtgttcgtttaacggaacgttcgggtaaccaaggttccaccgttcccgttaaggttcccaacgacccgaaacggccccaacccacgttcgttcctttaacccg

SEQ ID NO: 417026 - DNA, 662 bp, Homo sapiens
  misc_feature: GZ8MTXP01EFGXO.19.78.H01.1.454.CMB.2.raw
  modified_base (222)..(222): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctctgcactggaaccngcagtgatgtagaaattctaacttgtctctgtacaacatacaaccaaataaacgaccccaaactcatacaatttatgatcgaccaacgtaaacgccggacccttacgtacggggtttctaaattcgctttctcctcggctaccaagtctagggaccaacgaccggtccctaccctagaactaactcgtcgtcgggtcctccgaggcctaggaggaccgaggtctagtaattactactgtctcggctactataacgtgacgtagggttcgttaacttctttacgtttaagttcggtttaccgttaacgggtaaacggttcgggggtaaaccttaacggggttaccctaaccgggttacccgttaacgggttcccgaaccggaccccggaaacccgggtaccccgtaaacccccttacggttccttaaccggtttaaccccg

SEQ ID NO: 417027 - DNA, 529 bp, Homo sapiens
  misc_feature: GZ8MTXP01A45MI.19.78.H01.1.454.CMB.2.raw
  modified_base (300)..(300): a, c, t, g, unknown or other
  modified_base (437)..(437): a, c, t, g, unknown or other
  modified_base (441)..(441): a, c, t, g, unknown or other
  modified_base (520)..(520): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcaacccaaataaacgccccaaactcatcatttangatgccactaagcggccctgtacggggtttctaatcgcttctcctggtctccaagtctaggacaaccgacggtccctccctgactaatctcgtcgggctccgaggctgaggacgaggctagattacactgctggctnatangcaggtctatcttcttatcgtctcggaacgttggaccaggtcacgttcttggttcaacgcccaacgcccaaccccgttntcgttctcg

SEQ ID NO: 417028 - DNA, 531 bp, Homo sapiens
  misc_feature: GZ8MTXP01D5YCV.19.78.H01.1.454.CMB.2.raw
  modified_base (365)..(365): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgccccaaactcatcatttatgaatgccactaagcggccctcaggggtttctaatcgcttctctggctccaagtctggcaacacggcctccctgacaatcctctgggctccaggctgnggacgagggctgattacactgctgctcatatgcagggtctatctcttatgtcttcggggaactggggaccaggtcaccgtctagtcagcccaaggcccaacccaactgttcacttctcgttccccacccttccttccgaacgagaagtacctggacgcgggctcgg

SEQ ID NO: 417029 - DNA, 557 bp, Homo sapiens
  misc_feature: GZ8MTXP01A5Q0B.19.78.H01.1.454.CMB.2.raw
  modified_base (263)..(263): a, c, t, g, unknown or other
  modified_base (279)..(279): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccanatcacccaaataaacnccccaaactcatcatttatgatcgccactaagcggccctcgtaggggtttctaatcgcttctcctggctcaagtctaggcaacaccggcctccctgacactctcgtggctccgaggctgaggacgaggctgtacttactactgctggctcatatgctggtctattctcttatcgtcgttcggtaacgttcgggaaccttaggtccctaacccggttccgttacgggttaccaacggaccccgaacgggaccccaaccccgttactcgttcctaacccg

SEQ ID NO: 417030 - DNA, 820 bp, Homo sapiens
  misc_feature: GZ8MTXP01A5C7C.19.78.H01.1.454.CMB.2.raw
  modified_base (262)..(262): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtaccaanatacacccaaataaacgccccaaactcatcaatttatgatcgaccactaaacgcggtacccctcgtaacgggggttttctaaatcgtcctttctccctcgggtccttaccctaaacggttccttacggggaaccaaccgtacccgggtaccccttacccccgttacggaaaccctaaacttccgtttacccgtcgggggtaccctttaccccggaaggggtcccgttagggaaacggggaacccgggtaagggtacccgtttagggtaaaccttttaaaccgttaaaccgttcgtaccgttacggggtcctttaaccgtaaatttaacgttcggaccgtaacgggtttcccggttaaacgttttccgttacccttttaaagtttccggtttacccgttttaacccggggaaaaccggtttacgggggaaaccccttaaacgggggttacccctaaaccccgggtttcccgttaacgggttacccgtaaccggtaacccccgtaaaccggggacccccctaaacccccgttaacgtttcccgttaacccgttaaccccg

SEQ ID NO: 417031 - DNA, 563 bp, Homo sapiens
  misc_feature: GZ8MTXP01DDHSK.19.78.H01.1.454.CMB.2.raw
  modified_base (267)..(267): a, c, t, g, unknown or other
  modified_base (282)..(282): a, c, t, g, unknown or other
  modified_base (302)..(302): a, c, t, g, unknown or other
  modified_base (444)..(444): a, c, t, g, unknown or other
  modified_base (448)..(448): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgattgttagaaaattctaacttgtctctggtaccaanatcaccaaataaacnccccaaaactcatcatttangatgacactaagcggcccttgacggggtttctaatcgcttctctcggctcaagtctacggacaacgacggccctccctgaaccatctcgtgggctaccagggctaggacggacgagggctagatttacactgctggccttanatgngcgtagttctactcttcttagtcgttcgtaacggtaacgttcgggaacttacggtccgaccgttcgttacggaccgaacgacccgaacgaccccaaccgttctcgttcctaaccg

SEQ ID NO: 417032 - DNA, 534 bp, Homo sapiens
  misc_feature: GZ8MTXP01EIEOC.19.78.H01.1.454.CMB.2.raw
  modified_base (439)..(439): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaacttgtctcctggtaccaacatcaacccaaataaacgcccccaaaactcatcatttatgatgccactaagcgccctcgaggggtttctaatcgcttctcctggctcaagtctaggacaacacggcctccctgacaatctctgggctcaggctgaggacgagctagattacgtactgctggctcgattatgcnggttctatcttcttatcgtcttaacggacttgggaccaaggtctaccgttcgttaggttcaacgtcccaacggccccaccgactcgttcgtaacc

SEQ ID NO: 417033 - DNA, 523 bp, Homo sapiens
  misc_feature: GZ8MTXP01BXWCZ.19.78.H01.1.454.CMB.2.raw
  modified_base (195)..(195): a, c, t, g, unknown or other
  modified_base (221)..(221): a, c, t, g, unknown or other
  modified_base (257)..(257): a, c, t, g, unknown or other
  modified_base (272)..(272): a, c, t, g, unknown or other
  modified_base (288)..(289): a, c, t, g, unknown or other
  modified_base (325)..(325): a, c, t, g, unknown or other
  modified_base (356)..(356): a, c, t, g, unknown or other
  modified_base (409)..(409): a, c, t, g, unknown or other
  modified_base (429)..(429): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacgagggtcctgggcccagtctgccctgactcagtctgcctcgtgtctggtctctggacngtcgtcaccatctcctgcactgaacngcagtgatgttagaaattctaactgtctctgtacanatcaccaaataaacncccaaatcatcattannatgcataagcgcctgagggtttctaatcgctctccnggctcaagtcaggacaacacgcctcccgtanacaatctctggctcgagctgaggacgagctgattacactgctggctcatatgnaggtctatctctaagtcgtnttaacgaacgttgggaaccaagggtccaaccgttccgagggttccaacgccccgaaaggccccaaaccccgttactccgttaacgttaaccccg

SEQ ID NO: 417034 - DNA, 503 bp, Homo sapiens
  misc_feature: GZ8MTXP01EM03F.19.78.H01.1.454.CMB.2.raw
  modified_base (437)..(437): a, c, t, g, unknown or other
tcagtactctcgtgcacgaccggtgctcgatttagtgtgagtagtttgggtttgggtgtcacaagaggcagcgctctcgggacgtctccaccatggcctgggctctgctgctcctcactctcctcactcaggcacagggtcctgggcccagtctgccctgactcagtctgcctccgtgtctgggtctcctggacagtcggtcaccatctcctgcactggaaccagcagtgatgttggaaattctaacttgtctctgtacaacatcaccaaataagcccccaaatcatcatttatgatgaccactaagcggaccctcgaggggtttctaatcgcttcctctggctccaagtctggcaacacggcctcctgacatctctggctcgagctgaggacaggctgatactactgctgctcatatgcgagtcgtatctcttatntcttcgacgtcggacgtaacgtcgacgttcttacgtcacgccgacggaccacccaaccgttcgtcc

SEQ ID NO: 417035 - DNA, 840 bp, Homo sapiens
  misc_feature: GZ8MTXP01CVQDE.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgtagaaattctaacttgtctctgtaccaacatacaaccaaataaacgaccccaaactcatactatttatagatacgaccaactaaacggccggtaccccttacgtacgggggttttaccttaaacttccggtcctttccttcccgttcgggtaccttacccgtaaaacgggttcccttaacggggaacccaaacccgtacccgggtacccccttacccccgttacggaaccctaaaaccgtttcccgttacccgttaccgggggtccctttaccccggaaacggggtccttacggggaacggggaaaccgggtacggggtacttaacgggtaaacttttaaccttaaccgttcggtaaccttggggtaccctttaccgtaaatttaaccgttggtaccgtaaacggggtttccgttaaatttcctttacgtttttaaacgtcgtttacccgtttaaccgggggtaaacccgttacgggggtaaaccccgttaaaacggggtttccccgtaaacccgggttacccggttacggttacccgtaaacccggaccccgaaaaccgggttccccaaaacccccgttcgttaacggttaacccgttaaccccg

SEQ ID NO: 417036 - DNA, 497 bp, Homo sapiens
  misc_feature: GZ8MTXP01BM80R.19.78.H01.1.454.CMB.2.raw
  modified_base (472)..(472): a, c, t, g, unknown or other
  modified_base (487)..(487): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtacaacatcaccaaataaagcccccaaatcatcattatgatgcactaagccgccctcagggtttctaatcgcttctcctgctcaagtctagcaacacgcctcctgacaatctctggctccgaggctgagacgaggctgattacactgctgctcatatgcaggtctatctcttatgtcttcggaacttgggacaaggtcaacgttccgttggcaancccaagcccaacccntcgttcaacc

SEQ ID NO: 417037 - DNA, 534 bp, Homo sapiens
  misc_feature: GZ8MTXP01AZVGP.19.78.H01.1.454.CMB.2.raw
  modified_base (308)..(308): a, c, t, g, unknown or other
  modified_base (361)..(361): a, c, t, g, unknown or other
  modified_base (367)..(367): a, c, t, g, unknown or other
  modified_base (376)..(376): a, c, t, g, unknown or other
  modified_base (515)..(515): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctccttactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgcccccaaactcatcatttatnatgccactaagcggccctcaggggtttctaatcgcttctctcggctcaagtcngacacncgcctcccngacatctctcgggctcgaggctgaggacgaggctagattacactgctgctcatatgcagtcgtatcttcttatcggtcttcggaactcgggacctaggttccacccgtacttacggttcacgcccaacggcccaacccncttcgtccaactttccccg

SEQ ID NO: 417038 - DNA, 569 bp, Homo sapiens
  misc_feature: GZ8MTXP01CS1GO.19.78.H01.1.454.CMB.2.raw
  modified_base (366)..(366): a, c, t, g, unknown or other
  modified_base (382)..(382): a, c, t, g, unknown or other
  modified_base (406)..(406): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaactgtctctgtacaacatacaacccaaataaacgacccccaaactcatacatttatgatgaccactaacgcggtccctcgaggggtttactaatcgtcttctctggctcaagtctagcaacncgcctcctagacatcncgtggctcgagctgagacgaggtntgattacatgctggctacatacgtgcgtaggttctacttcttacttagttcgttcgttaacgggaacttggggaaacccttaagggtccctaccgttaccgttacggttaccaacgaccccgaaacgggacccctaacccttacgtcgttaaccttaaccccg

SEQ ID NO: 417039 - DNA, 593 bp, Homo sapiens
  misc_feature: GZ8MTXP01AU9UY.19.78.H01.1.454.CMB.2.raw
  modified_base (197)..(197): a, c, t, g, unknown or other
  modified_base (223)..(223): a, c, t, g, unknown or other
  modified_base (276)..(276): a, c, t, g, unknown or other
  modified_base (294)..(294): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgcacatctcctgcactggaaccngcagtgatgttagaaattctaacttgtctctgtacaacatacaccaaataacnccccaaactcatcattangatcaccactaacgccggccctcgtagggtttctaatcgcttctcctggctaccaagtctacggaccaacgaccggccctccctagactaactctacgtgggcctccgaggcctaggacggacgaggctagtacttactactcgctcgggtactctaattacgtgctagggttcgtaacttcttacgttattcggttcgttaacggaacgttacgggaaccttaacggtcctacccggttcgttacggttccaaccgacccgaaccggccccaaaccccttcgtcgttccgttaacccg

SEQ ID NO: 417040 - DNA, 584 bp, Homo sapiens
  misc_feature: GZ8MTXP01CHJDX.19.78.H01.1.454.CMB.2.raw
  modified_base (227)..(227): a, c, t, g, unknown or other
  modified_base (261)..(261): a, c, t, g, unknown or other
  modified_base (294)..(294): a, c, t, g, unknown or other
  modified_base (459)..(459): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtgaaattctaactgtctctgtacanatcaccaaataacgccccaaactcatcatttangatgaccactaagccggtccctcgtaggggtttctaatccgcttccgtcctcggtctaccgaaagttcctaacgggaccaaccaccgggtccctacccgtgaccaacttctcgtgggcctccgaggcgtgaggacgaggtctgattactactgcctggctcatangtcaggttctattctcgttatcggttacttaacggtaacgttcggggaaccacgggttcctacccggttccgttaggttccaacgaccccgaacggcccctaaccccattcggttccgtaacccg

SEQ ID NO: 417041 - DNA, 536 bp, Homo sapiens
  misc_feature: GZ8MTXP01EBGS7.19.78.H01.1.454.CMB.2.raw
  modified_base (251)..(251): a, c, t, g, unknown or other
  modified_base (279)..(279): a, c, t, g, unknown or other
  modified_base (297)..(297): a, c, t, g, unknown or other
  modified_base (425)..(425): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttntctctgtacaacatcaaccaaataaacnccccaaatcatcatttangatgccactaagcgccctcgagggtttctaatcgcttctcctggctccagtctaggcaacgacgccctccctgacaatctctgggctccgagctgaggacgaggctgattactactgctggctcatangctagtcgtatcttcttatgttcgttcggtaacgttacgggtaccttaaaggtccaccgttccgttacggttccaacgacccaacggcccaaccccgacttcgttctaacc

SEQ ID NO: 417042 - DNA, 532 bp, Homo sapiens
  misc_feature: GZ8MTXP01ERJHO.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaaccaaataaacgccccaaactcatcatttatgatgccactaagcgccctcaggggtttctaatcgctctctggctcaagtctggcaacacggccctccctgacaatctctggctccaggctgagacgagggtctgattactactgctggctcaatatgcgagttcgtatctccttattcgtcgttaacggaacttggggaccttaaaggtctaccgttcgttaggttccaacgcccaacggcccaacccactcgttcctaacc

SEQ ID NO: 417043 - DNA, 801 bp, Homo sapiens
  misc_feature: GZ8MTXP01CASDE.19.78.H01.1.454.CMB.2.raw
  modified_base (224)..(224): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccngcagtgatgttagaaattctaacttgtctctggtacaacatcaccaaataaacgccccaaactcatcatttatgatgaccaactaaacgccggccctcgtacgggggtttctaaactcgtccttcttcctcggcttacccgaaagttctacgggaccaacgaccgggtcccctaccctagaacctaacttcctcgtcggggccttcccgaagggtcccgttaggaacgggaaccggaacgggtccgttaggtaaactttaccgtaaacgttcgtccgttcggggtacttaccgtaagttaaacgttcgggtacccgttaacggggttacccggttttaaacttcccgttttaccttttaaacgttccggttttaaccccggttttaaccgggggtaaaacccgttttacggggggaaaccccgttaaaccgggggtttaccccgtaaacccccgggttttaaccccgttaaccgggggtttacccctaaacccggggtaaccccccgtaaaaccgggggtacccccccaaaaccccccgttaaccgtttaacccggttaacccctttaaacccccgg

SEQ ID NO: 417044 - DNA, 550 bp, Homo sapiens
  misc_feature: GZ8MTXP01C302H.19.78.H01.1.454.CMB.2.raw
  modified_base (438)..(438): a, c, t, g, unknown or other
  modified_base (536)..(536): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaacttgtctctgtacacatcaccaaataaacgcccccaaactcatcatttatgatcgaccactaagcggccctcgaggggtttctaatcgcttctcctggctccaagtctacgggacaacacggccctccctagaccaatctcgtgggcctccgaggctgaggacgaggctgattactactgctggctcatangcaggttctattctcttatcgtcttcggaacttcggggaaccaaagggtcccaccgttccgttaggttccaacggaccccaaggccccaaaccccttnttcgccttaacccg

SEQ ID NO: 417045 - DNA, 667 bp, Homo sapiens
  misc_feature: GZ8MTXP01BGLOV.19.78.H01.1.454.CMB.2.raw
  modified_base (243)..(243): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaactgtctctgtacaacatcaaccaaataacnccccaaatcatcattatgatgccactaagccgcctcgtagggtttctaatcgcttctctggctacaagtctgacaacacggcctccctgacaactcctctgggcctcccgaggacctggaacggacgaagggtctagtaattacctaacgtcgctgcctacagttatgaccgtagggttaccttattccgttactttaagttcgttaccgttacgggggtaaacgttcggggaaccctaacgggtaccctaacccggttccgtaacgggttacccaaccggtaacccctaaacgggcccctaaacccctcgtaccgttacctaacccgttcccgttacccgttcccccttacccccgttcccgttacccgaaccgggtaacgtaaccggttaccgtacgggacggccggggttcgtaaccgggg

SEQ ID NO: 417046 - DNA, 515 bp, Homo sapiens
  misc_feature: GZ8MTXP01CDOPA.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataaagccccaaactcatcatttatgatgccactaagcggccctcaggggtttctaatcgcttctcctggctccaagtctggcaacacggcctccctgacaatctctgggctcaggctgaggacgaggctgattactactgctggctcatatgcaggtcgtatctcttatgtctcggaacttgggaccaggtcaccgttcgttgttcaacgcccaaggcccaacccactcgttctaacc

SEQ ID NO: 417047 - DNA, 530 bp, Homo sapiens
  misc_feature: GZ8MTXP01A0YJH.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaacgccccaaactcatcatttatgatcgccaactaacgccggccctcgtagggggtttactaatcgtcttctcctggctccaagtctggccaacacggccctccctgacaatctctgggctccgaggctggaggacgaggctagattacactgctggctcatactgcgaggtctatctcttatgtcttcggaacttgggaccaaggtcaacgttcgttaggttcaacgcccaaggcccaaccactcgttctaacc

SEQ ID NO: 417048 - DNA, 522 bp, Homo sapiens
  misc_feature: GZ8MTXP01EW83F.19.78.H01.1.454.CMB.2.raw
  modified_base (300)..(300): a, c, t, g, unknown or other
  modified_base (447)..(447): a, c, t, g, unknown or other
  modified_base (455)..(455): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatcacccaaataaagcccccaaactcatcatttangatgccactaagcgccctcgtaggggtttctaatcgcttctcctggctcaagtctaggcaacacggcctcctgacaatctctgggctccgaggctgagggacgagggctgattactactgctggcttcatatgcaggtcgtatcttnttatcgtnttcggaacttgggacccaaggtcaccgttcgttggttcaagcccaacggccaacccatcgttcctcc

SEQ ID NO: 417049 - DNA, 559 bp, Homo sapiens
  misc_feature: GZ8MTXP01CTRU1.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtaccaacatacaacccaaataaacgacccccaaactcatacatttatgatcgaccactaagccggaccctcgagggtttactaatcgtcttctcctggctacctaagtctaggaccaacgacggccctccctagaacaatctctcgggctccgaggctgaggacgagctgacttactactgctggctcatacgtgcgaggttctatctattatcgtcgttaacggaacttgggaaccttaggtccaccgttccgttagttccgaacgacccgaacggaccccaacccgctcgttcctaacccg

SEQ ID NO: 417050 - DNA, 534 bp, Homo sapiens
  misc_feature: GZ8MTXP01DY3TT.19.78.H01.1.454.CMB.2.raw
  modified_base (319)..(319): a, c, t, g, unknown or other
  modified_base (406)..(406): a, c, t, g, unknown or other
  modified_base (433)..(433): a, c, t, g, unknown or other
  modified_base (442)..(442): a, c, t, g, unknown or other
  modified_base (449)..(449): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaacttgtctctgtacaacatcaccaaataaacgccccaaaactcatcaatttatgatgccaactaagcggccctnaggggtttctaatcgcttctctggctccaagtctcggcaacacggccctccctgactaatctcttcgggctccaggctgaggaacgnggctgattactatgctggctcatatgngacggtttntatcttnttatcgtcgtaacggtacgttcggaaccgttaagtccgtaccgttacgttacgcgaacgaccaacgcccacccactcgttctaac

SEQ ID NO: 417051 - DNA, 629 bp, Homo sapiens
  misc_feature: GZ8MTXP01CUH8M.19.78.H01.1.454.CMB.2.raw
  modified_base (263)..(263): a, c, t, g, unknown or other
  modified_base (277)..(277): a, c, t, g, unknown or other
  modified_base (294)..(294): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcacgtggaaccagcagtgatgttagaaattctaacttgtctctgtacanatcaccaaataacnccccaaatcatcattangatgccataagcgccctcgagggtttctaatcgcttctcctcggctcctaagtcctacggactaaccgaccggtccctaccctgaaccaacttctcgtcgggtctaccgaggctagaacgggacgaggtctagtattactactgctggtctactatctgcgtaggttcgttatcttccttagtcgttcgttaacggtaaaccgttcggggtaaacccgacgggttacccgaaccccggtttaccggttacggttaccgtaaccccgggaaaccccgaaacccggggtaacccccgtaaacccccttacgttcccggttaacccgtttaacccccg

SEQ ID NO: 417052 - DNA, 571 bp, Homo sapiens
  misc_feature: GZ8MTXP01D5HZ2.19.78.H01.1.454.CMB.2.raw
  modified_base (456)..(456): a, c, t, g, unknown or other
  modified_base (468)..(468): a, c, t, g, unknown or other
  modified_base (475)..(475): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtacaacatacaaccaaataaacgacccccaaactcaatcaatttatagatcgaccaactaacgcggccccttacgtagggggtttactaaatcgcttctcctcggctaccaagtctacggacaacgaccggccctaccctagaactaatctcgtgggctccgaggctagaggacgaggctagattacgactgctgctnatatgctaggtntattctnttatcgttcgttaacggaacgttcggaaccgttaaggtcctaacccgttcgttacggccaacgacccaaggaccccaacccacttcgttctaaccc

SEQ ID NO: 417053 - DNA, 527 bp, Homo sapiens
  misc_feature: GZ8MTXP01EUD9C.19.78.H01.1.454.CMB.2.raw
  modified_base (351)..(351): a, c, t, g, unknown or other
  modified_base (366)..(366): a, c, t, g, unknown or other
  modified_base (467)..(467): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaaccttgtctcctggtaccaacatcacccaaaataaagcccccaaaatcatcatttatgatgccactaagcggcctcagggtttctaaatcgcttctctggctccaaagtctggcaacacggcctccctgacaatccnctggctccaggctgnggacaggctgattacactgctgctcatatgcagtcgtatctcttatgtctcggggaactggaccaaggtcacgtctaggtcacgcccaaagcccaaacccntcgttcaacttcctgttccccaccttccttccaaccgagaactactgagtcgggctcggg

SEQ ID NO: 417054 - DNA, 529 bp, Homo sapiens
  misc_feature: GZ8MTXP01CJHJJ.19.78.H01.1.454.CMB.2.raw
  modified_base (364)..(364): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcgccctcaggggtttctaatcgcttctctggctccaagtctggcaacacggcctccctgacaatcctctgggctccaggctggnggacgagggctgattactactgctgctcatatgcaggtcgtatctcttatgtcttcggggaactggggaccaaggtcaccgtctaggtcagaccaaggccaaccccaactgttcacttctcgtcccgcccttccttccaacgagcgtactggacgcgggctcggg

SEQ ID NO: 417055 - DNA, 527 bp, Homo sapiens
  misc_feature: GZ8MTXP01C6MUH.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcacccaaataaagccccaaactcatcatttatgatgccactaagcggcccttcaggggtttctaatcgcttctcctggctccaagtctaggcaacacggccctaccctgacaatctctgggctccaggctgaggacgaggctgattactactgctggctcatatgctaggtctatctcttatcgtcttcggaacttggggacccaaagggtccaccgttccgttgggttccaagacccaaggcccaacccactcgttcaacc

SEQ ID NO: 417056 - DNA, 550 bp, Homo sapiens
  misc_feature: GZ8MTXP01D8CP7.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtacaacatcaccaaataaacgccccaaactcatcatttatgatgccactaacgcgccctcgagggtttctaatcgcttctcctggctcaagtctacggacaacgacggccctccctgacaactctctggctcgagctgaggacgaggctgattactactgctggctcgatatagtcagggtcttaattcttctttatcgttcttaacggtaagttcgggaccttaaggtccacccgttcgttaggttccaacgacccgaacggacccacccttactaacgttcgtaaccc

SEQ ID NO: 417057 - DNA, 582 bp, Homo sapiens
  misc_feature: GZ8MTXP01B73JY.19.78.H01.1.454.CMB.2.raw
  modified_base (264)..(264): a, c, t, g, unknown or other
  modified_base (324)..(324): a, c, t, g, unknown or other
  modified_base (357)..(357): a, c, t, g, unknown or other
  modified_base (517)..(517): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatcaaccaaataaacgccccaaatcatcattangatgccactaagcggcctcgtagggtttctaatcgcttctctgctccaagtctgacaacncgcctcctgacaatcctctggctccgaggctgnggacgaggctgattactactgctgctcatactgcaggtctatcttcttaatcgtcgttacggggaacttggggaacctaagggtccaccgtcgtaggtaccacgtaacccaacggcccaaaccccgaacttcgttcctaccttccgttccggttcccccnccccgttccttacccgaaccggaacgtaacggttaccgacgggaccgggtccggggcgtccgggg

SEQ ID NO: 417058 - DNA, 748 bp, Homo sapiens
  misc_feature: GZ8MTXP01DIK2G.19.78.H01.1.454.CMB.2.raw
  modified_base (361)..(361): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgccccaaatcatcattatgatgccactaagcgccctcgagggtttctaatcgcttctctggctcaagtctggcaacacggcctccctgacatcctctggctccgagctagnggacgagggctagacttactactgctgctacattagtgacgtaggttccgtaattccttacttaagttcgttacccgtttaacggggggtaaacccgttagggggtaaacccctaaaacgggggttccctaaacccccgggtttacccgttaacgggggttaacccaaacccgggtaacccccccgtaaaaaccgggggcccccctaaaaaaccccccccgggttaactttacccgggttacccctaaacccctttcccgtttaccccggggttttccccccccgttccccccgttttaccccttacccccgaaaccgggtaaacggttaaccggttaaccccggttagggaaccggggtccccggggttaacggttaacccggggg

SEQ ID NO: 417059 - DNA, 509 bp, Homo sapiens
  misc_feature: GZ8MTXP01BDT92.19.78.H01.1.454.CMB.2.raw
  modified_base (315)..(315): a, c, t, g, unknown or other
  modified_base (415)..(415): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtacacatcacccaaataaagcccccaaactcatcatttatgatgccactaagcgccctnagggggtttctaatcgcttctcctggctccaagtctaggcaacacggcctccctgacaatctctgggctccaggctgaggacgaggctgattacactgcnggctcatatgcaggtcgtatctcttatgtctcggaacttgggaccaaggtcacgttccgttggcaagcccaaggcccacccactcgttctaacc

SEQ ID NO: 417060 - DNA, 696 bp, Homo sapiens
  misc_feature: GZ8MTXP01D68F9.19.78.H01.1.454.CMB.2.raw
  modified_base (263)..(263): a, c, t, g, unknown or other
  modified_base (278)..(278): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaanatcaccaaataaacnccccaaactcatcatttatgatcgaccaactaacgccggtccctcgtacggggtttctaatcgcttctctcggctcaagtctaggaccaacgaccggtccctccctacgaacctaactcgttccgtcggggccttacccgaggccgttaggaacgggtaacggaacgggtcgtacggtaatttaccgtaacgttcgtccgttgggtacctactaattaacgtcgtccggtaaacggtttcgttaactttcctttactttaacgttgtttcccggttaacgggtaaaccgttacggggtaaacccgttaaacgggttccctaaccccgggtttacccgttacgggttacccgtaacccggacccccgaaaccgggttccccaaaaccccgttcgttaaccggttaaccctttaaccccg

SEQ ID NO: 417061 - DNA, 504 bp, Homo sapiens
  misc_feature: GZ8MTXP01AVEQ7.19.78.H01.1.454.CMB.2.raw
  modified_base (418)..(418): a, c, t, g, unknown or other
  modified_base (421)..(421): a, c, t, g, unknown or other
  modified_base (428)..(428): a, c, t, g, unknown or other
  modified_base (430)..(430): a, c, t, g, unknown or other
  modified_base (434)..(434): a, c, t, g, unknown or other
  modified_base (436)..(436): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgtgtctcctggacagtcggtcaccatctcctgcactggaaccagcagtgatgttggaaattctaacttgtctctggtaccaacatcaccaaataaacgccccaaactcatcatttatgatgaccactaagcgccctcagggtttctaatcgcttcctctgctccaagtctggcaacacggcctccctgacatctctggctcagctgacggacgaggctgattactactgctgctanatngctagtntntctntntgtctacggacgtcggacgacggtcaccgttcacggtcacgaacccgaacgacccaccctcgttcgtc

SEQ ID NO: 417062 - DNA, 531 bp, Homo sapiens
  misc_feature: GZ8MTXP01BEAUJ.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacaacatcacccaaataaacgccccaaactcatcatttatgatgccactaagcgccctcaggggtttctaatcgcttctcctggctccaagtctaggcaacacggccctccctgacaatctctcgggctccaggctggaggacgtaggctgattacactgctggctcatagtgcaggtctattctcttatcgtctcggaacttggggaccttaggtctaccgttcgttacggttcaacggcccaacggcccaacccactcgttaactaacc

SEQ ID NO: 417063 - DNA, 512 bp, Homo sapiens
  misc_feature: GZ8MTXP01ASP5W.19.78.H01.1.454.CMB.2.raw
  modified_base (426)..(426): a, c, t, g, unknown or other
  modified_base (439)..(439): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggccaccatctcctgcactggaaccagcagtgatgttagaaattctaacttgtctctgtaccaacatcacccaaataaacgccccaaactcatcatttatgatcgccactaagcgccctcaggggtttctaatcgcttctcctggctcaagtctaggcaacacgcctcctgacaatctctgggctcgagctgaggacgaggctgattactactgctggctcatacngcaggtctatctnttatgttctcggaacttgggaacaggtcacgttccttgcaacgcccgaagcccaacccgactcgttctaaccg

SEQ ID NO: 417064 - DNA, 687 bp, Homo sapiens
  misc_feature: GZ8MTXP01B35R6.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaattctaacttgtctctgtacaacactcaaccaaataaacgaccccaaactcatactatttatgatcgacctaacgtaacgccgtaccctacgtaacgggggtttacttaaacgttccgtctttcctaccgtcgggtaccttacccgtaaacgttccgtaacgggaccaaccgtacccggtccccttaccctacgaactaacgttccgtcgtcgggctaccggaggtctaggaggacggaggtctagtacttacgtactcgactcggcttactagtagtcggtacgtacggttcgttaattccttacgtttagttccggttacggtttaaccgggaaaccgttacggggtaaacccttaacgggtacccgtaacccggttccgttacggttaccgaacccgaccccggaacggacccccaacccgttacttccgttcctttaaccccg

SEQ ID NO: 417065 - DNA, 587 bp, Homo sapiens
  misc_feature: GZ8MTXP01B06Z3.19.78.H01.1.454.CMB.2.raw
  modified_base (264)..(264): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacanatcaccaaataacaccccaaatcatcattatgatgaccactaacgcgccctgtagggtttactaatcgtcttctccgtcggtctaccaagtcgtacggacaaccgacggtccctccctgaacctaactctacgtcgggtactccgaggctaggacgggaacgaggtctagacttactactgctggctacgatagtgacgtacggttcttaacttcttcctttagtcgttcgttcggaaacgttcggggaccttaagggtcctaaccgttccgttaggttaccaacgacccgaacgccccaaaccccttgtcgttcctaacccg

SEQ ID NO: 417066 - DNA, 703 bp, Homo sapiens
  misc_feature: GZ8MTXP01DCXRX.19.78.H01.1.454.CMB.2.raw
  modified_base (467)..(467): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcgtagtagtagttggttaagttaaacttaccttaacgttcgtccttacggtacgtaaaccaaactactaaccaaaaccctaaaataaaccccaacccctaaaactactaactactttaaagtttagtacgtacgtaccgacctaaacgtaacggccccgtcccgttagggttacgggtttactaacgtccgttcttctcgtcgtctacgtagtcgacgaacaaccgccgtccctacgtanactactctcggtcgtctacggagtcgagacggacgcgtctagtactaacgtcgtcgtcgtcgtactatatcgtacgtacgttcgttacttacttctttacgttcgttaccgtttacggtaaacggtacggttaccggtaaaccgttaaccgtacccgttaccggttacggttacgaaccgtaacccgaaacccgtaaccccgtaacccctaccgttacgttcccgttaacctcccg

SEQ ID NO: 417067 - DNA, 596 bp, Homo sapiens
  misc_feature: GZ8MTXP01C747I.19.78.H01.1.454.CMB.2.raw
  modified_base (265)..(265): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgattgtagaaattctaacttgtctctgtaccaanatacaccaaataaacgccccaaactcatcatttatgatgaccactaacgccggacccttcgagggtttctaactcgtcttctcctggctcaagtctaggacaacgacggccctccctagacaactctcgtgggctccgaggtcgtaggaacggacgacggtctagtaacttaacgtctgccgttgtactagtatagtcgtcgtacggttcgttacttcttacgttacgttcgttaccggttaacggtaacgttacgggtaaccgttacggtccgtaccgttacgttcgaccaaccgacccgaaccgtacccaccgttactcgttccgtccg

SEQ ID NO: 417068 - DNA, 602 bp, Homo sapiens
  misc_feature: GZ8MTXP01ANH9F.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaaccaaataacgaccccaaactcatactatttatgatcgaccactaacgcgtaccctcgtagggtttactaatcgtcttctcctcggctccaagtctacggaccaacgaccggccctaccctagactaactctcgtcggctccgaggctggaggtacgaggtctagacttactactgctggtctactaagtatacgcgtaggttcttacttctcgtttactcgttccgttaacggaacgttgggtaaacccttaacggttaccgtacccgttacgttacggttaccgaaccgacccgaacggacccctaacccgttactccgttaacctcccg

SEQ ID NO: 417069 - DNA, 811 bp, Homo sapiens
  misc_feature: GZ8MTXP01EOPK1.19.78.H01.1.454.CMB.2.raw
  modified_base (261)..(261): a, c, t, g, unknown or other
  modified_base (278)..(278): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacanatacaaccaaataaacnccccaaactcatctatttatgatcgaccaactaacggccggtaccccttcgtacgggggttttactaaactccgtactttcgttccgttcgggtaccttacccgtaaacggttccgttaacgggaccctaaccgtacccgggtaccccttaccccgtacggaaacctaaacttcccgttaccgttaccggggtccctacccggtaacgggtccgttacgggaacggggtaaaccgggtaacggggttaccgttacggttaactttaaccgttaaccgttacggtacccgttacggggtccttaccgttaacttaacgttacggtaccgttaacgggtttaccgtttaacgtttccgtttactttaacgtttcggtttccggtttaaccgggttaaaccggttaccggggtaaacccgttaaacgggtacccgtaaccccggttacccggttacggttcccgaaaaaaacccggtccccgaaacccggacccccgtaaaccccttaccgttaaccggttaacccgttaaccccg

SEQ ID NO: 417070 - DNA, 515 bp, Homo sapiens
  misc_feature: GZ8MTXP01BGUIT.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacacatcacccaaataaacgcccccaaactcatcatttatgatgccactaacgcggcccctcgtaggggtttctaatcgcttctcctggctccaagtctggacaacaccgcctccctgacatctctgggctcgagctgaggacgaggctagattactactgctgctcatatgcaggtctatctcttatgtcttcggaacttgggaccaaggtccaccgttcgttggttcaacgcccaaggcccacccgactcgttctcc

SEQ ID NO: 417071 - DNA, 522 bp, Homo sapiens
  misc_feature: GZ8MTXP01BAF79.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcacccaaataaacgccccaaactcatcatttatgatgccactaacgcgccctcaggggtttctaatcgctttctcctggctccaagtctagggcaacacggccctccctgacaatctctcgggctcccaggctggaggacgaggctggattactactgctggctcatatgcaggtctatctctatgtcttcggaacttgggaccaggtccaccgttcgttggttcaacgcccaacggcccaacccatcgttctaacc

SEQ ID NO: 417072 - DNA, 551 bp, Homo sapiens
  misc_feature: GZ8MTXP01DK0K6.19.78.H01.1.454.CMB.2.raw
  modified_base (361)..(361): a, c, t, g, unknown or other
  modified_base (392)..(392): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttatgatgccactaagcgccctcgagggtttctaatcgcttctctggctcaagtctggcaacacggcctcctgacatcctctggctcaggctgnggacgaggctgacttactactgctgctcatntgcgagtctatcttcttatcgtacgttcggggaacgtcggaccgtacggtctaccgtcgtacggtcacgccccgaagcccaacccaatcgttacctacttcgtcgtccccgttcccttccttcccaaggacgtcgtactggacgtccgggcgtaacggg

SEQ ID NO: 417073 - DNA, 537 bp, Homo sapiens
  misc_feature: GZ8MTXP01AD6C9.19.78.H01.1.454.CMB.2.raw
  modified_base (426)..(426): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataagcccccaaatcatcatttatgatgccactaagcggccctcgtaggggtttctaatcgcttctctggctccaagtctaggcaacacggcctcctgacaatctctgggctccgagctgagacgaggctgattacactgctggctcattagngcgtagtctatcttcttatcgtcgttaacggaacgttcggtaaccacggtcctacgttcgttacggaccaacgacccgaaccggaccccaacccgttctcgttcctaaccg

SEQ ID NO: 417074 - DNA, 670 bp, Homo sapiens
  misc_feature: GZ8MTXP01BCZQV.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtacaacatacaaccaaaataaacgaccccaaactcatactatttatagatcgaccaactaacgccggccctcgtaggggtttactaactcgtcttctcctcggtctccaagtctaacggactaaccgacggtccctccctacgaactaacttcgtcgttcgggccttacccggagggtccgttagggaacggggacgtacggggtacttagtaaccttacgttaacgtcgtaccgttaggggtcttcgaaattacgtcgggcctaaggggttccttatttccttcgtttaagtccgtttcgtttaaccgggaaacgttacgggggtaaccaaacggtccgtaaaccccgttcgttacggaccgaacgaccccgaaaccggtacccaccccttactaacgttcccgtaaccc

SEQ ID NO: 417075 - DNA, 629 bp, Homo sapiens
  misc_feature: GZ8MTXP01BRR5S.19.78.H01.1.454.CMB.2.raw
  modified_base (300)..(300): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaaccaaataacaccccaaactcaatctatttangatcgccaactaacgcgccctgtaggggtttctaatcgcttctcctggctcgaagtctagcaacgacgtccctcctagactaatcctcgtcggctacgaggtctaggaggaccgaggtctagacttactacgtgcctggtctacgattacgtcggctacgggttactacttcttacgtttagtcggttcgttaacggggaaaacgttccggggaaaccttagggttacccgtaacccggttaccgttaacggggttacccgtaaccggaaccccgtaaaccggggaccccctaaaccccgttacggttaacccgttaaccgtaaccccg

SEQ ID NO: 417076 - DNA, 599 bp, Homo sapiens
  misc_feature: GZ8MTXP01AMUKW.19.78.H01.1.454.CMB.2.raw
  modified_base (304)..(304): a, c, t, g, unknown or other
  modified_base (346)..(346): a, c, t, g, unknown or other
  modified_base (477)..(477): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactaggaaccagcagtgtatgttagaaattctaacttgtctctgtacaacactacaaccaaactaacacccaaactcatacatttatnatcgcactacgcgcctcgagggttctatcgcttctctcgtcncgtactctcggaccaacgacgcctccctgacactctcgtcgggtctccgagccgtagacggacgaggtctagaacttactacgtcgtccttagggcttacgtataaccgtgtcgtacgggttacgttactnttcctttagtcgttcgttaaccggaacgttcgggtaaccgaaggtcccgtaaccgttccgttacggacccgtaacggacccgaaacggttaccccaacccgttacttccgttcgtaaccccg

SEQ ID NO: 417077 - DNA, 541 bp, Homo sapiens
  misc_feature: GZ8MTXP01D3SY3.19.78.H01.1.454.CMB.2.raw
  modified_base (267)..(267): a, c, t, g, unknown or other
  modified_base (527)..(527): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacaacatnaccaaataagcccaaatcatcattatgatcgaccactaagccgccctcgtaggggtttctaaatcgtcttctcctggctaccgaagtcgtacggcaacgacgggtccctccctagacaactctctcggctccaggctgaggacgaggctgacttactatgctggctcattactgcgaggtctattctcttatgtctcggaaacgttgggacttaaacgtcgtaccgttcgttggttacaacgcccaacggcccaaacccnctcgttaactcccg

SEQ ID NO: 417078 - DNA, 552 bp, Homo sapiens
  misc_feature: GZ8MTXP01BEV7A.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacaacatcaaccaaataaacgcccccaaactcatcatttatgatgaccactaacgccgccctgtaggggtttctaatcgtcttctcctcggtctaccaagtctaaggaccaacgaccgccctccctgactaactctcgtgggctccgagctggaggacgaggctgattactactgctggctacatatgctaggttcgtatcttacttatcgttcgttaacggaacgttggggaaccttaaggtccaccgttcgttagggttccaacgcccaacggcccaacccgctcgttctcc

SEQ ID NO: 417079 - DNA, 561 bp, Homo sapiens
  misc_feature: GZ8MTXP01BE7UI.19.78.H01.1.454.CMB.2.raw
  modified_base (264)..(264): a, c, t, g, unknown or other
  modified_base (299)..(299): a, c, t, g, unknown or other
  modified_base (466)..(466): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggtccagtctgccctgactcagtctgcctccgtgtctgggtctcctggacagtcggtcaccatcctcctgcactggaaccagcagtgatgttagaaattctaacttgtctctgacanatcaaccaaataaacgacccaaactcatcatttangatgaccaactaacgcggccctcgtacggggtttctaatcgtcttctcctggctccaagtctaggcaacaccggcctccctagactaatctctcgggctccaggctgacggacgagctgattactacgtgactggctctatagtcgctagggtctaactcttacttntcgttcgttaacggtaacgttgggaccgttaaaggtccgtaaccgttcgacgttccgaacgacccaacggacccaacccactcgttcctaacccg

SEQ ID NO: 417080 - DNA, 505 bp, Homo sapiens
  misc_feature: GZ8MTXP01CEU61.19.78.H01.1.454.CMB.2.raw
  modified_base (265)..(265): a, c, t, g, unknown or other
  modified_base (308)..(308): a, c, t, g, unknown or other
  modified_base (339)..(339): a, c, t, g, unknown or other
  modified_base (394)..(394): a, c, t, g, unknown or other
  modified_base (401)..(401): a, c, t, g, unknown or other
  modified_base (409)..(409): a, c, t, g, unknown or other
  modified_base (422)..(422): a, c, t, g, unknown or other
  modified_base (426)..(426): a, c, t, g, unknown or other
  modified_base (432)..(432): a, c, t, g, unknown or other
  modified_base (434)..(434): a, c, t, g, unknown or other
  modified_base (443)..(443): a, c, t, g, unknown or other
  modified_base (447)..(447): a, c, t, g, unknown or other
  modified_base (449)..(449): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgccctcgtgtctgggtctcctggacagtcggtcaccatctcctgcactggaaccagcagtgatgttgaaattctaaacttgtctctggtaccaanatcaacccaaaataaacgccccaaaactcatcaatttatgatncactaagacggcctccagggtttactaatcncttctccttgctcaactactggcaacaacggccctccctcacaaatctctgggcncacgcgngagagagntatatactatgcngctntatatngngtgtatctntatntntcgacgagacgacgtactacgcgttcgcaacaccgaacgaccacccactcgttctc

SEQ ID NO: 417081 - DNA, 591 bp, Homo sapiens
  misc_feature: GZ8MTXP01DMGR0.19.78.H01.1.454.CMB.2.raw
  modified_base (229)..(229): a, c, t, g, unknown or other
  modified_base (243)..(243): a, c, t, g, unknown or other
  modified_base (259)..(259): a, c, t, g, unknown or other
  modified_base (278)..(278): a, c, t, g, unknown or other
  modified_base (316)..(316): a, c, t, g, unknown or other
  modified_base (331)..(331): a, c, t, g, unknown or other
  modified_base (373)..(373): a, c, t, g, unknown or other
  modified_base (549)..(549): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaanatcaccaaataacncccaaatcatcattangatgccactaagcgacctnagggtttctaatcgcttctctggctcaagtctgcaacncgctcctgacactcnctggcctcgagctgaacggacgacgctagtacttaactcgtncgtgtctacattagagtacgtacggttacgttaacttcttattacgttcgtttaccgttacgggggtaaaccgttcggtaaaccgttacgggtacctacccggttacgttacggaccgaaccgtacccgaaccggacccaacccgtaacgtcttacctccttcgtcccgttccccncccttccttacgaacgagcgtacgcgacggcgttcgaacggg

SEQ ID NO: 417082 - DNA, 526 bp, Homo sapiens
  misc_feature: GZ8MTXP01EYDAZ.19.78.H01.1.454.CMB.2.raw
  modified_base (280)..(280): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcacccaaataaacnccccaaactcatcatttatgatgccactaagcgccctcaggggtttctaatcgcttctcctggctccaagtctagggcaacacggcctccctgacaatctctgggctccaggctgaggacgaggctgattacactgctggctcatatgcgaggttctatctctttatcgttcgtcggaacgttgggaccaaagggtcaaccgttcgttaggttcaacgacccaacggcccacccatcgttctaacc

SEQ ID NO: 417083 - DNA, 536 bp, Homo sapiens
  misc_feature: GZ8MTXP01BJRX8.19.78.H01.1.454.CMB.2.raw
  modified_base (205)..(205): a, c, t, g, unknown or other
  modified_base (365)..(365): a, c, t, g, unknown or other
  modified_base (382)..(382): a, c, t, g, unknown or other
  modified_base (428)..(428): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtaaccntctcctgcactggaaccagcagtgatgttaggaaattctaaccttgtctcctggtaccaacatcaacccaaataaacgcccccaaactcatcatttatgatgccactaagcgccctcgaggggtttctaatcgcttctctcggctcaagtctggacaacncggcctcctgacaatcnctgggctcgagctgagagagctgattacactgcttgctcatactgntaggtctatcttcttaatgtcttagggaacttcgggactaacggttccaccgtcccttagggttccacgcccgaacggcccaaccctacttcgtccttaaccgttccc

SEQ ID NO: 417084 - DNA, 532 bp, Homo sapiens
  misc_feature: GZ8MTXP01AG9IC.19.78.H01.1.454.CMB.2.raw
  modified_base (459)..(459): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcaacccaaataaacgcccccaaactcatcatttatgatgccactaacgcggccctcgtagggggtttctaatcgcttctcctggctacaagtctaggcctaacacggccctccctgacaatctctcggggctccgagggctggaggacgaggctagaattactactgctggctcatatgctaggtctatctnttatcgtctcgaacttgggaccagtcctacgttcgttggttcaacgacccaacggcccacccgatcgctaacc

SEQ ID NO: 417085 - DNA, 569 bp, Homo sapiens
  misc_feature: GZ8MTXP01CV02A.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaccaaataaacgacccccaaactcatcatttatgatgccactaagcggccctcaggggtttactaatcgtcttctcctggctccaagtctaggcaacacggccctccctgacaatctcgtcgggctccaggctgaggacgagctgattactactgctggctacattatcgcgagttcgtattctcttattcgttcttaacgggtaacgttcggggaaccttaagggtacctaccggttcccgttaaggttcccgaacggaccccaacgggtaccccaaccccacgttcgttccgttaacc

SEQ ID NO: 417086 - DNA, 578 bp, Homo sapiens
  misc_feature: GZ8MTXP01CMJXQ.19.78.H01.1.454.CMB.2.raw
  modified_base (302)..(302): a, c, t, g, unknown or other
  modified_base (435)..(435): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacacatacaaccaaataacaccccaaactcatacatttatgatnaccactaacgcggccctcgtaggggtttctaatcgtcttctcctggctcaagtctaggacaacacggccctcctgacaactctcgtcgggctccgaggctggacggacgaggctagattactactgctggctnattatcgcgtagtcgttattcgtcttatcgttcgttaacggtaacgttcgggtaaccaggtacctccggttccgttaggttcccgaaccggaccccgaaacgggacccctaaccccgttacgttccggttaaccttaaccccg

SEQ ID NO: 417087 - DNA, 799 bp, Homo sapiens
  misc_feature: GZ8MTXP01ECCHO.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtgatgttagaaattctaacttgtctctgtacaacatacaaccaaataaacaccccaaactcaatctaatttatagatcgaccaactaaacggccggtaccccgttacgtacgggggtttttactaaacttccggtcctttccgttccccgttacgggacctttacccgtaaacggttcccgttaacggggaccctaacccggtaacccggggtcccccttaccccgtacgggtaaaccccttaaacgttcccgtttaccggtacggggtcccttaccccgggaagggtccgttaagggaacgggtaaaccgggaggggttacctaggtaaactttaacctaacgttacggtaccttcggggtaccttaacgtatttaacgtcggtaccgttacggggtttacgtttaaacttcctttaccgtttaaagtttcggtttaaccggtttaaccgggtaaacgttaccggggtaaacccgttaacggtcccgttaaaccgttcccggttacggttaccgaaccgaaccccgaacggaacccctaccccgaacttccgttaacgtttaaccccg

SEQ ID NO: 417088 - DNA, 525 bp, Homo sapiens
  misc_feature: GZ8MTXP01ATXTX.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaagcccccaaactcatcatttatgatgccactaagcggccctcagggggtttctaatcgcttctcctggctccaagtctgggcaacacggcctccctgacaatctctgggctccgagctgaggacgagctagattacactgctgggctcatatgcgtagggtctatctcttatgtcttcggaacttgggaccaaggtcaccgttcgttgttcaacgcccaaggcccaacccgatcgttctaaccg

SEQ ID NO: 417089 - DNA, 524 bp, Homo sapiens
  misc_feature: GZ8MTXP01BBTZ3.19.78.H01.1.454.CMB.2.raw
  modified_base (263)..(263): a, c, t, g, unknown or other
  modified_base (370)..(370): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacaanatcacccaaataaagcccccaaactcatcatttatgatgccactaagcggccctcaggggtttctaatcgcttctcctggctcaagtctggcaacacggccctcccngacaatctctgggctccaggctggaggacgaggctgattactactgctggctcatatgcagtccgtatctcttatcgtcttcggaacttggggaccaagggtccaccgttccgttggttcaacgccccaaggccccaacccactcgttctaacc

SEQ ID NO: 417090 - DNA, 516 bp, Homo sapiens
  misc_feature: GZ8MTXP01ADHJX.19.78.H01.1.454.CMB.2.raw
  modified_base (438)..(438): a, c, t, g, unknown or other
  modified_base (451)..(451): a, c, t, g, unknown or other
  modified_base (487)..(487): a, c, t, g, unknown or other
  modified_base (506)..(506): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacgccccaaaactcatcatttatgatgcactaagcgcctctaggggtttctaatcgcttctcctggctccaagtctagggcaacacgggccctcctagacaactctctgggctccaggcgtgaggacgaggctgacttactactgctagggctcattangcgtgtctatctnttatcgtctaacggacgttggacagtccacgttcgngcaacgaccaacgccaccnctcgttcctc

SEQ ID NO: 417091 - DNA, 698 bp, Homo sapiens
  misc_feature: GZ8MTXP01A0G03.19.78.H01.1.454.CMB.2.raw
  modified_base (223)..(223): a, c, t, g, unknown or other
  modified_base (261)..(261): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccngcagtgatgttagaaattctaacttgtctctgtacaanatcaccaaataaacgccccaaactcatcatttatgatgccactacgcgtccctgtagggtttctaatcgcttctcctggctcgaagtctacggacaacgaccggtccctacccgtagacctaactcgtcgtcgggtcctccgaagggtccgttaggacgggaacggtaacgggtccttaggtaactttaacgtaacgttggtccttcggggtaccttaccgtaattacgttacggtacccgttaaggggttcctttaaacgtttcctttaccgtttaagtttccggttacgtttaaccggggtaaaccgttcgggggtaaacccttaacggggttaccctaacccgggtttacccgttaacgggttacccgaaaccggaacccccggaaacgggaccccctaaaccccttaaccgttccggttaaccgttaaccccg

SEQ ID NO: 417092 - DNA, 558 bp, Homo sapiens
  misc_feature: GZ8MTXP01B0B9I.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaactgtctctgtacaacatcaccaaataaacgccccaaactcatcatttatgatgaccactaacgccggccctgtacggggtttctaatcgcttctcctggctccaagtctaggacaacgacggccctccctgacaactctctgggcctccaggctggaggacgaggctgtacttacgtactgctcggctcatatgctagggttcttatcttcttagtcgttcgtaacggtaacgttcgggaaccttaaggtcctaccgttcgttagggttccaacgacccgaacggccccacccgttactcgttcctaaccg

SEQ ID NO: 417093 - DNA, 604 bp, Homo sapiens
  misc_feature: GZ8MTXP01ENRJQ.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaaccttgtctctggtaccaacatcaacccaaataaacgccccaaactcatcatttatgatgccaactaagcgccctctaggggtttctaatcgcttctcctggctccaagtctacggcaacaccggccctccctgaactaatctctggctcgaggctggagacgagggctgattactactgccttggctactatagtcgcgtacggttcgtactttcttactttagtcgttccgttaacggaaacggttacgggtaacccgttaacgggttaccgtacccggttaccgttacgggttaccaacccggaccccgaaccgggacccctaacccccgacttcggttaacccgttaaccccg

SEQ ID NO: 417094 - DNA, 520 bp, Homo sapiens
  misc_feature: GZ8MTXP01AF8EN.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtacaacatcacccaaataaacgccccaaactcatcatttatgatgcactaagcggccctcaggggtttctaatcgcttctcctggctccaagtctaggctaacacggccctccctgacaatctctgggctcaggctgagacgagctgattacactgctggctcatactgcaggtcgtatctcttatcgtcttcgaacgttgggaaccaggtccaccgttccgttaggttcaacgccaacggcccaacccactgctaacc

SEQ ID NO: 417095 - DNA, 539 bp, Homo sapiens
  misc_feature: GZ8MTXP01EK9Y4.19.78.H01.1.454.CMB.2.raw
  modified_base (362)..(362): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaacatcaccaaataaacgaccccaaactcatcatttatgatgaccactaacgcggccctcgtaggggtttctaatcgcttctcctggctcaagtctaggcaacncggcctccctgacaatctctgggctcgaggctgaggacgagctgattactatgctggtctctatactgcgtaggtcgtatcttcttatcgttcgttaacggaacgttcgggaccttaaggtccaccgttcgttacgggttcaacgacccaacggcccaacccacgtcgttctaaccc

SEQ ID NO: 417096 - DNA, 599 bp, Homo sapiens
  misc_feature: GZ8MTXP01D0WAU.19.78.H01.1.454.CMB.2.raw
  modified_base (263)..(263): a, c, t, g, unknown or other
  modified_base (341)..(341): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctgaccaacatcaccaaataaacgccccaaactcatcattangatgccactaagcggcctcgagggtttctaatcgcttctctggctcaagtctggcaacacggcctcctgacaactccnctgggctccgaggcctgaaggacgagggctagacttactactgactgctcgatatgacaggttcgtatcttcttaagtgttacgttacggggaaacttcggggaacctaaagggttcctaacccgtcgtaggtaccgtacgacccaaacggaccccaaaccccaacttcgttcctaaccgttcctacccggttccccaccccgttcccttaccgaacggtacgtaacgttacgtaggcggaaccgggcgtaaccgggg

SEQ ID NO: 417097 - DNA, 764 bp, Homo sapiens
  misc_feature: GZ8MTXP01A3S1Q.19.78.H01.1.454.CMB.2.raw
  modified_base (264)..(264): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaanatacaacccaaataaacgacccccaaactcaatctaatttatgatcgaccaactaaacggccggtaccctacgtagggggtttactaactcgtctttctcccgtggtactacccgaaaggtcctaacgggaccaaccgtaacccgggcccttaccccgtagtaacctaaacgttccgtacgtcggggccttaccgacgggtaccgtaggaacgggaaccggacggtaccgttaggtaaactttaccgtaacgtcggtacccttggggtaccttaaccgtaacttagttacggcccgtaaaggggttccgttaaactttccgttacgtttaacgttcggtttcccggtttaaacgggtaaacccggttacgggggtaaacccgttaagggttaccccgttaacccgggttaccgttccgggttaccgtaacccggaaccccggttaaaccgggtaccccccgaaaaccccttccgttaaccggttaacccgtttaaccccg

SEQ ID NO: 417098 - DNA, 568 bp, Homo sapiens
  misc_feature: GZ8MTXP01BK8T0.19.78.H01.1.454.CMB.2.raw
  modified_base (423)..(423): a, c, t, g, unknown or other
  modified_base (440)..(440): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgtagaaattctaacttgtctctgtacaacatcaacccaaataaacgccccaaatcatcatttatgatcgaccaactaagccgccctcgtagggtttctaaatcgcttctcctggtctcaagtctaacggacaacgacggccctcccgtgactaatctctggctccaggctgagacgagctgattactangctggctcatagtgcgngttcgtattctcttatcgttcgttaacggaacgttgggaacccttaaggtccctaaccgttcccgttaaggttcccaacggtccccgaaacgggccccaaaaccccgttcgtaacgttcttaaccccg

SEQ ID NO: 417099 - DNA, 531 bp, Homo sapiens
  misc_feature: GZ8MTXP01C2KUB.19.78.H01.1.454.CMB.2.raw
  modified_base (277)..(277): a, c, t, g, unknown or other
  modified_base (296)..(296): a, c, t, g, unknown or other
  modified_base (299)..(299): a, c, t, g, unknown or other
  modified_base (403)..(403): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaacncccccaaatcatcatttangangccactaagcgccctgaggggtttctaatcgcttctcctggctccaagtctaggccaacaccggccctccctgacaatctctgggctccgaggctggaggacgnggctgattactactgctggctcatagtgctaggtctatctattatcgttcttcggaacttcgggaaccaaggttcaccgttcgttaggttcaacgcccgaacggccccaacccactcgttctaacccg

SEQ ID NO: 417100 - DNA, 572 bp, Homo sapiens
  misc_feature: GZ8MTXP01CSORV.19.78.H01.1.454.CMB.2.raw
  modified_base (383)..(383): a, c, t, g, unknown or other
  modified_base (436)..(436): a, c, t, g, unknown or other
  modified_base (441)..(441): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacacatcaccaaataacaccccaaactcatcatttatgactgaccaactaacgccgtaccctcgaggggtttacaatcgtcttctcctggctcaagtctaggacaacgacggccctcctgacatcncgtgggctcgaggctaggacggacgaggctagacttacactgctgctacatancgacnggttctatcttacttattcgttcgttaacgggaacgttcgggtaaaccacgggtacccaccggttaccgttacgggttccaaccggaccccgaaccggaccccaaacccttcgtccgttaaccgttccccg

SEQ ID NO: 417101 - DNA, 557 bp, Homo sapiens
  misc_feature: GZ8MTXP01EMX6B.19.78.H01.1.454.CMB.2.raw
  modified_base (411)..(411): a, c, t, g, unknown or other
  modified_base (433)..(433): a, c, t, g, unknown or other
  modified_base (440)..(440): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataaacgccccaaactcatcatttatgatgaccactaagcgccctgtaggggtttctaatcgcttctcctggtctcctaagtctagggcaaccgcggccctccctgacctaatctcgtgggctccgaggctgagaacggngctgacttactactgctggctnatagtgngtagttcttacttcttacttatcgttcgttaacggaacgttcggaaccttacggtacctaccgttcgttacggacgaaccgacccgaaccgacccaacccacttcgttccgtaaccg

SEQ ID NO: 417102 - DNA, 619 bp, Homo sapiens
  misc_feature: GZ8MTXP01DZOYU.19.78.H01.1.454.CMB.2.raw
  modified_base (262)..(262): a, c, t, g, unknown or other
  modified_base (296)..(296): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacaanatacaccaaataaacgccccaaatcatcatttangatcgaccataacgcgccctgtacgggtttctaatcgcttctctcggctcgaagtctacggacaacgaccggtccctaccctagactaactcgtcgtcgggctcgaggctaggacggacgaggtcctaggtaacttactacgtgcgtggacttactaatagttcgaccgtagggttaccttattcgttacctttagtcgttacgtaacggtaacgttcgggtaaaccgaacggttacccgaaccgttacggttacggttacccgaaccggaacccgaaccgggtaccccaaaccccgttacgttaacgttcccgttaaccccg

SEQ ID NO: 417103 - DNA, 553 bp, Homo sapiens
  misc_feature: GZ8MTXP01AZYQ2.19.78.H01.1.454.CMB.2.raw
  modified_base (225)..(225): a, c, t, g, unknown or other
  modified_base (259)..(259): a, c, t, g, unknown or other
  modified_base (430)..(430): a, c, t, g, unknown or other
  modified_base (455)..(455): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccngcagtgatgttgaaattctactgtctctgtacanatcaccaaataacgcccaaactcatcatttatgatgccactaagcgccctcgtagggtttctaatcgcttctcctggctcaagtctaggcaacacggcctccctgactaactctacgtcgggtctccgaggctggacggacggacgtctagtacttactactgctcgctanatagtgcgagtcgttatctactttnttcgtcgtaacggtaacggttacggtaacgttacggtaccgtaccgttacgttcgaccgaaccgaccgaaccgacccacccgttactcgttccgtccg

SEQ ID NO: 417104 - DNA, 552 bp, Homo sapiens
  misc_feature: GZ8MTXP01EZQ7Q.19.78.H01.1.454.CMB.2.raw
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaatcatcatttatgatgccactaagcggccctcgagggtttctaatcgcttctctggctccaagtctggcaacacggcctcctgacatcctctggctcgaggctgaaggacgaggctgattactactgctgctcatatgactaggttctatcttcttatgtcgttcggggaacttggggaacctaaggtccaccgtccgtaggtccacgacccaacggcccaaaccccaatcgttcaccttctccgttccccacccttcccttccaacgagtaacgtactggacgcgggcgtcggg

SEQ ID NO: 417105 - DNA, 540 bp, Homo sapiens
  misc_feature: GZ8MTXP01AICPE.19.78.H01.1.454.CMB.2.raw
  modified_base (261)..(261): a, c, t, g, unknown or other
  modified_base (459)..(459): a, c, t, g, unknown or other
  modified_base (510)..(510): a, c, t, g, unknown or other
  modified_base (516)..(516): a, c, t, g, unknown or other
  modified_base (532)..(532): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattcaacttgctctggtacaanatcaaccaaataaacgcccccaaactcatcatttatgatcgaccactaagcgccctcagggggtttcaatcgcttctcctggctccaagtctggctaacaccggccctccctagaccaagtctacgtcgggcttacccgaagggtcctaggaacgggacgagggctacggaatttacgtacgtgctggtctcaattanggcaggtcttatctcttatgtctggaacttgggaccaaggtccacgttcgnggttcngccaatcgaccacccnttgtaacc

SEQ ID NO: 417106 - DNA, 534 bp, Homo sapiens
  misc_feature: GZ8MTXP01AY9FF.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtacacatcaaccaaataaacgccccaaactcatcatttatgatgccactaagcggccctctaggggtttctaatcgcttctcctgctcaagtctaggcaacacgccctccctgactaatctctgggctcgaggctgaggacgaggctagattactactgctggctcatatgcgtagtcgttatctcttagtcgttcttcggtaacgttgggaaccttaggtcctaccgttccgttaggttccaacgcccaacggcccaacccgactcgttctaacc

SEQ ID NO: 417107 - DNA, 590 bp, Homo sapiens
  misc_feature: GZ8MTXP01BFT8I.19.78.H01.1.454.CMB.2.raw
  modified_base (455)..(455): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcacccaaataacgccccaaactcatcatttatgatgaccactaacgcggccctgtaggggtttctaatcgctttctctggctccaagtctggaccaacaccggtccctccctgactaactctccgtgggcctccgaggcgtacggacggaaccggagggtcctggtaacttacctacgtgcttgggacttnaacttatgacgtaggttcgttaacttcttctttaagtcgttcgtttaacggaacgttgggtaaccttaacggtcctaccgttccgttacggttcgaaccgcccaacggccccaacccttacgtcgttcctaaccc

SEQ ID NO: 417108 - DNA, 523 bp, Homo sapiens
  misc_feature: GZ8MTXP01CYQPN.19.78.H01.1.454.CMB.2.raw
  modified_base (377)..(377): a, c, t, g, unknown or other
tcagtactctcgtgcacgaccggtgctcgatttagtgtgagtagtttgggtttggggggtgtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgcccccaaatcatcatttatgatgccactaagcggccctcgagggtttctaatcgcttcctctggctccaagtctggcaacacgcctccngacatctctgggctcagctgaggacgagctgacttactactgctgcttcatatgctaggtcgtatcttcttatgtcttcggaatcgggacgtaagtcaccgttcttacggtcacggcccaaggcccaacccctaacgttcgtaacc

SEQ ID NO: 417109 - DNA, 530 bp, Homo sapiens
  misc_feature: GZ8MTXP01CDKRH.19.78.H01.1.454.CMB.2.raw
  modified_base (360)..(360): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctggtacaacatcaccaaataaacgccccaaactcatcatttatgatgccataacgcgccctcagggggtttctaatcgcttctcctggctcaagtctaggcaacncggcctccctgacaatctctcggctccgagctggaggacgaggctgattacgtaactgctggctcgatagtgcgtaggtcgttatcttcttattgttcttcggaacttgggaaccagtcaccgttcgttggttcaacgcccgaaggcccaacccactcgttcgtaacccg

SEQ ID NO: 417110 - DNA, 534 bp, Homo sapiens
  misc_feature: GZ8MTXP01C3X2J.19.78.H01.1.454.CMB.2.raw
  modified_base (307)..(307): a, c, t, g, unknown or other
  modified_base (409)..(409): a, c, t, g, unknown or other
  modified_base (436)..(436): a, c, t, g, unknown or other
  modified_base (439)..(439): a, c, t, g, unknown or other
  modified_base (451)..(451): a, c, t, g, unknown or other
  modified_base (526)..(526): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatacacccaaataaacgcccccaaactcatcatttatnatgccactaagcgccctcgagggtttctaatcgcttctctggctcaagtctaggcaacacgcctccctgacatctcgtgggcctcgaggctaggaggaacgnggctagattacactgctggctcgatangcngggtctatcttnttatgttcgtaacggaacttgggaccaaaggtccaccgttcgttcggttcaacgcctaacggcccaaccccgttntcgttctc

SEQ ID NO: 417111 - DNA, 638 bp, Homo sapiens
  misc_feature: GZ8MTXP01CVHA7.19.78.H01.1.454.CMB.2.raw
  modified_base (367)..(367): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctggtaccaacatcaacccaaataaacgcccccaaactcatcatttatgatcgaccaactaagccgccctcgtaggggtttctaatcgtcttctcctggctcaagtctagcaacncggccctccctagaccaatcctcgtacgggctaccgagggctaggaacgggacgagggtcttaggtaacttactacgtgaccgttgggtacctctaattacgtcgtaccgtaacgggttcgttaaacttccttactttacgttcggtttaccgttaaccgggtaaacgttcgggggaaaccccgttaaaggtacccgtacccgttaccgttcggttaccgaaccgtaccccgaacggtaccccaacccttacgttcgttccgttaaccccg

SEQ ID NO: 417112 - DNA, 504 bp, Homo sapiens
  misc_feature: GZ8MTXP01DU1Y7.19.78.H01.1.454.CMB.2.raw
  modified_base (264)..(264): a, c, t, g, unknown or other
  modified_base (474)..(474): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtacanatcaccaaataaagccccaaactcatcattatgatgcactaagcggccctcaggggtttctaatcgcttctcctggctccaagtctaggcaacacgcctccctgacaatctctggctccagctgagacgagctgattacatgctggctcatatgcagtcgtatcttcttatgtctcgaagttgggaccaagtccacgttcgttggttacngacccaacggcccaacccactcgctaaccc

SEQ ID NO: 417113 - DNA, 611 bp, Homo sapiens
  misc_feature: GZ8MTXP01C4OSB.19.78.H01.1.454.CMB.2.raw
  modified_base (276)..(276): a, c, t, g, unknown or other
  modified_base (295)..(295): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgtgaaattctaacttgtctctgtacaacatacaccaaataaacnccccaaactcatcatttangatcgaccactaacgcgcccttcaggggtttcaatcgcttctcctggctcagtctgacaacacgcctcctgacaatctctggctcgagctgaggacgaggctagacttactacgtgactggtctactaattacgtacgtcgtacggttcttaacttccttacgtttaacgtcgtttaacgttaaccgggtaaacgttaccggggtaaacccgaaacgggtttacccgaacccggtttaccgttacggggttacctaaccgggacccctaaacgggacccctaaaccccgttacgttcgttaacccgttaaccccgg

SEQ ID NO: 417114 - DNA, 714 bp, Homo sapiens
  misc_feature: GZ8MTXP01D2OQY.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgacaacatcaccaaataaacgccccaaactcatcatttatgatgaccaactaacgccggcccttacgtagggggttttactaaacttcgtctttacctcctggcctaccaaacgtctacgggacaaccgaccgggcccttaccccgtacgaacctaacttccgttcgtcggggtcccttaccgacgggtaccgttagggaacgggtaaccgggtaagggtccgttaggtaaactttaacgtaactaggtacccttggggtaccttacgtaattaagttcggaccgttaaaggggttcttaactttctttacgttagttacgttccgttaaccgggtaacgttacgggggtaaccccttaaacgggttaccgaacccggtttacccgttagggttaccaaccggtaaccccgaaacgggtcccccaaaccccttaccgttaaccgttcccgttaaccccg

SEQ ID NO: 417115 - DNA, 593 bp, Homo sapiens
  misc_feature: GZ8MTXP01BSBW2.19.78.H01.1.454.CMB.2.raw
  modified_base (226)..(226): a, c, t, g, unknown or other
  modified_base (278)..(278): a, c, t, g, unknown or other
  modified_base (296)..(296): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttagaaattctaactgtctctgtacaacatcaccaaataaacnccccaaactcatcattangatgccactaagcgccctgtagggtttcaatcgacttctacctggtctccaagtctacggacaacgaccgggcctcccgtacgacctaatctcgtgggctccaggctggaggacgaggctgacttactatgcctggctacattacgtgaccgtaggttcgttaattcttactttagttcggttccttaacgggtaacgttcggggtaaacccttaagggtccgtaacccggttccgttacggttaccgaaccggacccgaacggacccaaccccttacgttcgttaaccttaacccg

SEQ ID NO: 417116 - DNA, 572 bp, Homo sapiens
  misc_feature: GZ8MTXP01DHU2Z.19.78.H01.1.454.CMB.2.raw
  modified_base (341)..(341): a, c, t, g, unknown or other
  modified_base (358)..(358): a, c, t, g, unknown or other
  modified_base (374)..(374): a, c, t, g, unknown or other
  modified_base (430)..(430): a, c, t, g, unknown or other
  modified_base (548)..(548): a, c, t, g, unknown or other
  modified_base (556)..(556): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctgtaccaacatacaacccaaataaacgacccccaaactcaatactatttatgatcgaccaactaagccggccctacgtagggtttctaatcgtcttctctggctcagtctgcaacnccgcctcctgacatccnctggctccgaggctgnggacgagctagacttactacgtgctgctcgatagtgactaggttctattcttattntcgttcgttacggggaacgtcgggaacctaacggtccaccgttcgtagtaccacgacccaacgcccaaccctaatcgttactacttcgttcccgtccccaccttccttaccaacgtanaacgtcgngacggcggttcgaacg

SEQ ID NO: 417117 - DNA, 785 bp, Homo sapiens
  misc_feature: GZ8MTXP01CIF8V.19.78.H01.1.454.CMB.2.raw
  modified_base (307)..(308): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctcggtaccaacatacaacccaaataaaacgcccccaaactcatactatttannatgaccaactaacgccggtacccttacgtagggggtttactaagtcctcttctccctcggtctacctaaagtctaacggaccaaccgtaccggtccctacccgtacgaacctaaacttccgtccgtcgggtacccttcccggaacgggtcttacgggaacgggaacggtaacgggtccgttaacgggtaaactttaccgttaaaccgttggtacccgtttcggggtaccctttacctaaagtttaacgttacgggtacccgttacggggtttaacgtttacctttcctttaccgtttaacgtttaccggtttccgtttaaaccggggtaaaccggttacggggtaaaccccgttaaacgggttaccccgtaaccccgggttaccgttaacgggttaccccgaaccgggaaaccccccgaaacccgggtacccccctaaaccccgttacccgttccggttaacccgtttaaccccccg

SEQ ID NO: 417118 - DNA, 554 bp, Homo sapiens
  misc_feature: GZ8MTXP01BZI29.19.78.H01.1.454.CMB.2.raw
  modified_base (265)..(265): a, c, t, g, unknown or other
  modified_base (280)..(280): a, c, t, g, unknown or other
  modified_base (298)..(298): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaanatcaccaaataaacnccccaaatcatcatttangatgccactaagcgccctgtagggtttctaatcgcttctcctcggctaccaagtctacggccaacgacgccctccctgaacatctcgtgggctccgaggctggaggacgaggctgattacactgctggctacatagtgcgtaggttctatcttcttattcgtcgttaacggaacgttcgggaaccttaggtccgaaccgttccgttagggttccaacgaccccgaacggaccccaacccacttcgttcctaacccg

SEQ ID NO: 417119 - DNA, 527 bp, Homo sapiens
  misc_feature: GZ8MTXP01BBOI1.19.78.H01.1.454.CMB.2.raw
  modified_base (379)..(379): a, c, t, g, unknown or other
  modified_base (425)..(425): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacaacatacaccaaataaagccccaaaactcatcatttatgatgccactaagcgccctgaggggtttctaatcgcttctcctggctccaagtctggacaacacggcctccctgacaatctcngggctccaggctgaggacgaggctgattacgtatcgctgctcatangcaggtctattctcttatcgtcttaacggacttgggaccaaggtcaaccgttccgttacggttcaacgcccgaacggcccaacccgctaacgttcgtaaccc

SEQ ID NO: 417120 - DNA, 554 bp, Homo sapiens
  misc_feature: GZ8MTXP01BB9JE.19.78.H01.1.454.CMB.2.raw
  modified_base (449)..(449): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttggaaattctaaccttgtctcctggtaccaacatcacccaaataaacgcccccaaactcatcatttatgatgccactaagcggccctctaggggtttctaatcgcttctcctggctccaagtctgggactaacgacggccctccctcgaacaactctcgtcggactccaggcgtagagggacgaggtctgaattactacgtgctggcttcaatntgcgagttcgtatcctcttatgtctaacggacgttgggaccaaggtcaaccgttccgttaggttccaaggcccctaacgggacccaaccccactgttcccgtaac

SEQ ID NO: 417121 - DNA, 755 bp, Homo sapiens
  misc_feature: GZ8MTXP01B742U.19.78.H01.1.454.CMB.2.raw
  modified_base (745)..(745): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgtatgttagaattctaacttgtctctgtaccaacatacaaccaaataaaccaccccaaatcatctattatgatcgaccacgtaacgccgcctacgtaggttactactcgtcttctactcggcctaccgaagtcgtacggacccaaccgaccggtccctcccgtagaacctaacttccccgtcggtcgggcctacccggaggtacgtacgggaacgggtacgtagggtaccttagtaactttaccgtacgtcggtcctgtaccttacgtaattacgtcggtacgttacgggttacttaacttcttacgtttacgttacggtttacccggttaacgggggaaccggttacggggtaaacccgtaaccgggttacccgtaaccccggttacccggtaggtaccccgaaccggaacccccgtaaaccggtaccccctaacccctaacgttcccgttaccctaccctttaccccgttacccgttaccccttaccccgttcccgttaccggaaccggtacggtaacggttaccggtacgggacgggttcccgggngtaacccggg

SEQ ID NO: 417122 - DNA, 541 bp, Homo sapiens
  misc_feature: GZ8MTXP01DS838.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcacccaaataaagccccaaactcatcatttatgatgccataagcgccctcaggggttctaatcgcttctcctggctaccgaagtctagcaacgacggccctccctgacaactctactgggctccgaggctggaaggacgaggctagattactactgctggcttcaattatgacagggttcttatcttcgttattcgtcttcggaacgttggggaaccaaaggtcctacccggttcttacgggcaacgaccaacggcccaacccactcgttctaacc

SEQ ID NO: 417123 - DNA, 586 bp, Homo sapiens
  misc_feature: GZ8MTXP01BIKQT.19.78.H01.1.454.CMB.2.raw
  modified_base (257)..(257): a, c, t, g, unknown or other
  modified_base (271)..(271): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccagcagtgatgtagaaattctaactgtctctgtacanatcaccaaataacnccccaaatcatcatttatgatcgaccaactaacgccggtccctacgtaggggttttactaatcgtcttctccgtcggtctaccaagtcctagggaccaacgaccggccctcccgtacgaacctaactctcgtcgggcttcccgaggtcgtggagggaccgaggtcctagtaattaccgtactgtctgggctacgtatatgccgtaggttctatcttcttatcgttcgtcggtaacgttgggtaccttaaggtccaccgttaccgttggttccaacggccccaacggccccaaaccccttcgttccgcttaacccg

SEQ ID NO: 417124 - DNA, 570 bp, Homo sapiens
  misc_feature: GZ8MTXP01B0U94.19.78.H01.1.454.CMB.2.raw
  modified_base (431)..(431): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcacccaaataaacgcccccaaactcaatcatttatgatgccactaagcggccctcaggggtttctaatcgcttctcctggctccaagtctggcaacatggcctccctgacaatctctgggctcaggctgaggacgaggctgattactactgctgtctcatatgcnggtcgtatcgttcttatcgtcgttcggaacgtcggggaacctaaacggggttccttaacccgggttccttaaacggggttccgaaacggtccccgaaacggggtacccccaaacccccgtaaccgtttcggttaacccc

SEQ ID NO: 417125 - DNA, 582 bp, Homo sapiens
  misc_feature: GZ8MTXP01ESQQL.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaacgccccaaatcatcatttatgatgaccactaacgcggccctcgtaggggtttctaatcgcttctctggctccaagtctagacaacacggcctccctgacaatctcgtcgggctccgagggctaggacggacgaggtctaggattactactcgtctgggcttcaagttatcgcgtaggttcgttatcttcctttaagtcgttcgttaacgggaacgttcgggaaccgttaacggtcctaacccggttccgttagggttaccaaccggacccaaccgggaccccaaccccttacttcgttcctaacccg

SEQ ID NO: 417126 - DNA, 747 bp, Homo sapiens
  misc_feature: GZ8MTXP01B2TLY.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaattctactgtctctgtacacatacaaccaaataaacgaccccaaactcatctattatgatcgaccaactaacgccggacccttgtacgggtttactaactcgcttctcctcggtctaccgtaagtctaggaccaacgaccggtccctccctacgacctaacttcgtcgttcggggcccttccggaacggtcgttacgggaacgggaaccggtacgggtaccttacggtaactttaaccgttaaccggttagtcccgttcggggtacctttaccgtaattaacgttacggccgttaaacggggtttccgttaaacgtttcctttaacgtttaacgtttccggtttaccggtttaaccggggtaaaccgttaccgggggtaaacccgttaaacggggttcccgtaaaccccgggtttcccggttaacgggttacccgtaaccggacccccgtaaacccgggtacccccaaaacccccgttaccgttaaccggttaacccttaacccccgg

SEQ ID NO: 417127 - DNA, 526 bp, Homo sapiens
  misc_feature: GZ8MTXP01D6XIR.19.78.H01.1.454.CMB.2.raw
  modified_base (224)..(224): a, c, t, g, unknown or other
  modified_base (275)..(275): a, c, t, g, unknown or other
  modified_base (449)..(449): a, c, t, g, unknown or other
  modified_base (515)..(515): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccngcagtgatgttagaaattctaactgtctctgtacacatcaccaaataaacnccccaaatcatcatttatgatgaccactaagcggccctcgtagggggtttctaaatcgcttctccttggctccaaagtctggaccaacacggcctcccctgaactaagtctactgggctccgaggctgaggacgaggctgattacactgctcggctcatatgcaggtctatctnttaatcgtcttcggaaacttggggaccaaggtccaacgttcttggttcaagcccaagcccaacccntcgttctaacc

SEQ ID NO: 417128 - DNA, 549 bp, Homo sapiens
  misc_feature: GZ8MTXP01BO92I.19.78.H01.1.454.CMB.2.raw
  modified_base (411)..(411): a, c, t, g, unknown or other
  modified_base (431)..(431): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaaattctaacttgtctctgtacaacatcaccaaataaacgccccaaactcatcatttatgatgccaactaacgcggccctcgtaggggtttctaatcgcttctcctggctccgaagtctaggcaacgacggccctccctagacaatctctgggctccaggctggaggacgagntcgattacactgcttggctnactatgctaggtctatctcttatcgtcgttaacggacttgggaaccttaggtacctacccgttcgttaggttccaacgaccccgaaggtccccaaaccccgttctcgttcctaacccg

SEQ ID NO: 417129 - DNA, 516 bp, Homo sapiens
  misc_feature: GZ8MTXP01CEM1V.19.78.H01.1.454.CMB.2.raw
  modified_base (425)..(425): a, c, t, g, unknown or other
  modified_base (504)..(504): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcacccaaataaacgacccccaaactcatcatttatgatgccactaagcggccctcagggggtttctaatcgcttctcctggctccaagtctaggcaacgacggcctccctgacatctctggctcaggctgaggacgagctgattacactgctggctcatangcagtcgtatcttcttatgtcttcggaacttgggaaccaggtcaaccgttcgttagttcaagcccaacggcccaacccnctcgttctaacc

SEQ ID NO: 417130 - DNA, 557 bp, Homo sapiens
  misc_feature: GZ8MTXP01EPI33.19.78.H01.1.454.CMB.2.raw
  modified_base (410)..(410): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcagtgatgttagaaattctaacttgtctctggtaccaacatcaacccaaataaacgcccccaaactcatcatttatgatgcactaagcgccctgtagggtttctaatcgcttctcctggctccaagtctaggcaacacggcctccctgactaatctctgggctccaggctggagaacggngctagattactactgctgctatatagtgacgtaggttctatcttattagtcgttcgttaacggtaacgttcgggaaccttaacggtccgtaaccgttcgttacggccaaccggacccgtaacgaccccaacccgttctcgttcctcg

SEQ ID NO: 417131 - DNA, 569 bp, Homo sapiens
  misc_feature: GZ8MTXP01B1GCV.19.78.H01.1.454.CMB.2.raw
  modified_base (261)..(261): a, c, t, g, unknown or other
  modified_base (278)..(278): a, c, t, g, unknown or other
  modified_base (557)..(557): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaattctaacttgtctctgacanatacaaccaaataaacnccccaaactcatctatttatgatcgaccactaaacgccggtcccttacgtacgggggtttactaacgtcgtcttctctcggtctacctaagtctaggaccaaccgacggccctaccctgactaatctcgtggcctcgaggctggaggacgaggtctgtattactactgctggtctatatagtcgatcggttcttagttcttcttatcgttctaacggtaacgttgggaacccaggtccctacttcgttacgttccaacgacccaacggaccccacccgntcgttcctcccg

SEQ ID NO: 417132 - DNA, 543 bp, Homo sapiens
  misc_feature: GZ8MTXP01ADA82.19.78.H01.1.454.CMB.2.raw
  modified_base (278)..(278): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtacaacatcaccaaataaancccccaaactcatcatttatgatgccactaagcggccctcgaggggtttctaatcgcttctcctggctccaagtctaggcaacacgcctcctgacaatctctgggctccgagctgaggacgaggctgattactactgctggctcatactgcaggtcttatctcttatgtcgttcggaacgttgggaacccaaagggtcctaacccggttccgttagggttcccaacggacccgaacggccccaaaccccgttctcgttcctaacc

SEQ ID NO: 417133 - DNA, 678 bp, Homo sapiens
  misc_feature: GZ8MTXP01AK1VW.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtacaacatcacccaaataaacgcccccaaactcatctatttatgatgccactaacgcgcccttcgagggtttctaatcgtcttctcctggctccaagtctagggccaacaccggccctcctgacctaatctcgtcgggtcctccgaggcctaggacgggaccgagggtcctaggtaacttactacttcggtactcgggcttaccattaacgtcgtaccgtacggggttactttaacttctttaccgtttaagttcgggtttccgttaacccgggtaaacggtttaccgggggaaacccttaaacgggtcccgtaaccccgtttaccggtttacgggttacccgaaacccggaccccgtaaaacccggggtacccccaaaacccccgttacgttcccgttaacccgtttaacccccg

SEQ ID NO: 417134 - DNA, 536 bp, Homo sapiens
  misc_feature: GZ8MTXP01BOW8Z.19.78.H01.1.454.CMB.2.raw
  modified_base (263)..(263): a, c, t, g, unknown or other
  modified_base (367)..(367): a, c, t, g, unknown or other
  modified_base (447)..(447): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacanatcaccaaataacgccccaaactcatcattatgatcgaccactaagccggcccttcgtagggggtttactaatcgtcttctcctggctccaagtctaggcaacncggcctccctgacatctctgggctccagctagagacgagctgattactatgctggctcattagtgcaggttctattcttnttacttgttcgtaacggtaacgttgggaccaggtcctaccgttcgttacgttcaacgacccaacgacccacccttactcgttcctaacc

SEQ ID NO: 417135 - DNA, 577 bp, Homo sapiens
  misc_feature: GZ8MTXP01CK2R2.19.78.H01.1.454.CMB.2.raw
  modified_base (477)..(477): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcacatctcctgcactggaaccagcagtgatgttagaaattctaacttgtctctgtaaccaacatacaacccaaataaacgccccaaaatcaatacaatttatgatgaccaactaaacgccgtccctacgtaaggggttttactaaatccgtcttctccgtggactaccaaagtctaggaccaacaccggtcctccctagaacaatctcgtggctccgaggcaggaggacgaggctagaacttactactgctggtctatatatgcgagtcgtatcctnttatgtcgttaacgtaacgttacggacgaacggtacgtaccgttaccgttacgttacgaacgacccgaaccggacccaacccacctaacgttcgtaaccc

SEQ ID NO: 417136 - DNA, 538 bp, Homo sapiens
  misc_feature: GZ8MTXP01DGDAO.19.78.H01.1.454.CMB.2.raw
  modified_base (384)..(384): a, c, t, g, unknown or other
  modified_base (448)..(448): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctggtaccaacatacaccaaataaacaccccaaactcatcatttatgatgccactaagcgccctcagggtttctaatcgcttctctcggctccaagtctaggcaacacggccctccctgacaatctacnggctcgaggctgaggacgaggctagattactactgactggctcattatgctaggtctattcttnttatcgtcgttaacggaacgttggaaccaagggtccacgttccgttggttaccaacgacccaacggccccaacccactcgttcctaaccg

SEQ ID NO: 417137 - DNA, 660 bp, Homo sapiens
  misc_feature: GZ8MTXP01DLYYW.19.78.H01.1.454.CMB.2.raw
  modified_base (305)..(305): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcaccatctcctgcactggaaccagcagtgattgttagaaattctaacttgtctctggtacaacatacaccaaataaacgccccaaactcatacatttactgatnaccactaacgcggtcccttcgtacgggggttttactaactcgtcttctcctggctcaagtctaggacaacgaccggtcctccctacgacaatctcgtcggcttccgaggctaggaggacggacggctacgtattactactcgacttcgggctactaagttacgtcgtacgtacgggttacgttaactctttacgtttaacgttcggttaccgtttaacggggtaaaccgttacgggggtaaacccgttaaacgggttacctaacccggggttacccgttacgggttaccgaaccggtaccccgtaaacgggacccccaaaccccgttacttaaccgggttaacctttaaccccgg

SEQ ID NO: 417138 - DNA, 565 bp, Homo sapiens
  misc_feature: GZ8MTXP01ED3Y4.19.78.H01.1.454.CMB.2.raw
  modified_base (205)..(205): a, c, t, g, unknown or other
  modified_base (257)..(257): a, c, t, g, unknown or other
  modified_base (433)..(433): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcgtcaccntctcctgcactggaaccagcagtgatgttagaaattctactgtctctgacanatacaaccaaataaacacccaaatcatcattatgatcgacctactaacgccgcccgttgtagggtttactaatcgtcttctcctggctacaagttcaacggacaacgcgccctacctagacactctcgtcggctccgagctagaggacgaggctagacttacgactgtctgtactntaatgtgacgtaggttcttatctttattagtcgttcggtaacggtacgttacggaaccgttaacggtcctacccggttacgttgttaccaacggaccccaaggaccccaccgaccttgttcccgttaacccg

SEQ ID NO: 417139 - DNA, 596 bp, Homo sapiens
  misc_feature: GZ8MTXP01EMA0H.19.78.H01.1.454.CMB.2.raw
  modified_base (297)..(298): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaaattctaacttgtctctgtacaacatcaaccaaataaacaccccaaactcatcattannatcgccactaagcgccctcgtagggtttctaatcgcttctcctggctcaagtctagacaacacgcctcctagacaatctctcggctccgaggctaggaggacgaggtctagaacttacgtactcgcttcggacttactaattacgtgcgtaaggttcgttaacttcttactttaagttcggttcgttaacgggtaaacgttcggggaaccttaacggtccgtaacccggttccgttacgggttccaaccggccccaaacgggacccctaaccccgttacttccgttccgttaaccccg

SEQ ID NO: 417140 - DNA, 661 bp, Homo sapiens
  misc_feature: GZ8MTXP01DFLLS.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaacttgtctctgtacaacatacaccaaataaacgccccaaactcatcaatttatgatcgaccaactaacgccggcccttcgacgggggttttactaaacttccgtctttcctcctcgggtacctcctaaagtccttaacgggacctaaccgaccgggtccccttaccctagaaccaacttcgtcgtcgggcctccgaggctggaagggacgacgggtactaggtacttactacgtcgccgtggtcttacgaattagtcgacgtacgggttacttacttcttacgtttaacgttcggttccgttaaccgggtaaacgttcggggtaaacccttaacgggtacccgtaccggttaccgttcggttaccaaccggaccccgaacggaccccaaccccacgttcgttaaccgttaacccg

SEQ ID NO: 417141 - DNA, 637 bp, Homo sapiens
  misc_feature: GZ8MTXP01C92JS.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaacttgtctctgtaccacatcaaccaaataaacgaccccaaactcatcatttatgatgaccactaacgccggtccctcgagggtttactaatcgcttctcctggtctcctaacgtcgtaacggcctaaccgccggtccctaccctgaactactctcgtcgggcctccgaggctggaaggacggtacggcttacggtattaacctacgttgtcccgttaggcttacctaagttacgtcggaccgttacgggttacgttaacttccgtttacctttaagttcgtttacgttaacgggtaacgttcggggtaaaccgacggttaccgtccgttacgttacggccgtaaccgacccgaaacggtaccccaacccgttctcgttaaccgttaaccc

SEQ ID NO: 417142 - DNA, 561 bp, Homo sapiens
  misc_feature: GZ8MTXP01CS6LZ.19.78.H01.1.454.CMB.2.raw
  modified_base (301)..(301): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataaacgccccaaactcatcatttangatgcactaagcggccctcagggtttctaatcgcttctcctggctcaagtctaggcaacacggcctaccctgacaatctctgggactccaggctggaggacgaggctgattacactgcttggctcgatactgcacggttcgtaacttcttactttattcgtcgttaacggaaacgttggggtaacccaaggttccgaacccgttccgttcggttaccaacggaccccaacgggccccaaacccactcggttcctaacccg

SEQ ID NO: 417143 - DNA, 529 bp, Homo sapiens
  misc_feature: GZ8MTXP01EAHXD.19.78.H01.1.454.CMB.2.raw
  modified_base (262)..(262): a, c, t, g, unknown or other
  modified_base (277)..(277): a, c, t, g, unknown or other
  modified_base (296)..(296): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaactgtctctgtaccaanatcaccaaataaacnccccaaactcatcatttangatgccactaagcgccctagaggggtttctaatcgcttctcctggctcaagtctaggcaacacggcctccctgacatctctgggctcgagctgaggacgaggctgattactactgctaggctcatatgcaggtctatctcttatgtcttaacggaacttgggaccttaaggtccgacgttccgttggttccaacggacccaacggccccaacccgactcgttaacctaacccg

SEQ ID NO: 417144 - DNA, 568 bp, Homo sapiens
  misc_feature: GZ8MTXP01A4WTN.19.78.H01.1.454.CMB.2.raw
  modified_base (226)..(226): a, c, t, g, unknown or other
  modified_base (376)..(376): a, c, t, g, unknown or other
  modified_base (397)..(397): a, c, t, g, unknown or other
  modified_base (440)..(440): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttagaaattctaacttgtctcctggtaccaacatacaacccaaataaacgacccccaaactcatacatttatgatgaccactaaacgcggccctcgtaggggtttctaatcgcttctccgtggctccaagtctaggcaacncggccctcctgacaatctcgnggctccagctgaggacgaggtctgacttactactgctggcttntatagtgccgtagtcgttatcttctttagtcgttcgtaacggtaacgttggaccgaacggtcctaccggttccgttacggttccaacgacccgaacggaccccaaccccgacgtcgttccgtaacccg

SEQ ID NO: 417145 - DNA, 599 bp, Homo sapiens
  misc_feature: GZ8MTXP01EGNTO.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaacatcaaccaaataaacaccccaaactcatctatttatgatcgaccaactaacggccgtccctcgtagggggtttactaatcgtcttctccgtcggctaccaagtctacggaccaacgaccggtccctccctacgaactaactctcgtcgggtcctccgaggctggaggacgaggtctagattactatgctggctactatatgcgtaggtcttactcttcttagtcgttacgttaacggtaacgttcgggaaccgttaacggtccgtacccgttaccgttacggcccgaacgaccccgaaacggacccccaacccgttacttccgttccgtaaccccg

SEQ ID NO: 417146 - DNA, 676 bp, Homo sapiens
  misc_feature: GZ8MTXP01BSBBI.19.78.H01.1.454.CMB.2.raw
  modified_base (263)..(263): a, c, t, g, unknown or other
  modified_base (299)..(299): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaattctaactgtctctgtaccaanatacaccaaataaacgaccccaaatcatacattatnatacgccaacgtaacgcggtccctagtacggggtttactaactcgtctttctcctggtctaccaagtctaacggaccaacgtacggccctccctacgactaactcgttcgcgggtcctaccgaggtctgggaacggaacgacgggtctagtaacttacctacgtgtccctaggtcgttactaagttacgtaggtaccgtagggtttaccgttaactttccttacttttaagtcgttaccggttaacgggtaaaacgttccggggtaaacccgttaaacggtcctaaacccgggttccgttaacgggttcccaaaccggtacccccgaaacgggttaccccccaaaacccggttactttccggttaaccgttccccgg

SEQ ID NO: 417147 - DNA, 582 bp, Homo sapiens
  misc_feature: GZ8MTXP01CSFIS.19.78.H01.1.454.CMB.2.raw
  modified_base (447)..(447): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaattctaacttgtctctgtaccaacatacaacccaaataaacgacccccaaactcatctatttatgatcgaccaactaacgccggtcccttcgaagggggttttctaatcgtcttctcctggctcgaagtctggacaacacggcctccctgacatctctgggctccgagctaggacggacgagggctagacttactactgctggctanatatgcgtaggtctatcttctttagtcgttcgttaacggaacgttcggggtaaaccagggttacccaccgttccgttaggttacccgaacggtaccccgaacgggcccccaacccgaccttcgttcctaaccccg

SEQ ID NO: 417148 - DNA, 553 bp, Homo sapiens
  misc_feature: GZ8MTXP01CE65X.19.78.H01.1.454.CMB.2.raw
  modified_base (439)..(439): a, c, t, g, unknown or other
  modified_base (539)..(539): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgttagaaattctaacttgtctctgtacaacatacaccaaataaacaccccaaactcatcattatgatgccaactaacgcgtacctcgagggtttactaatcgtcttctcctggctccgaagtctacggacaacaccggccctaccctgacaactctcgtcgggctccgaggctagaggacgacggctgtattacactgcttggctnatagtgcgtaggtccttatcttccttatcgtcgtttcgaacgttcgggtaacaacggtcctaccgttcgttacggttcaacgcccaacggcccaaacccnctcgttcgtaaccc

SEQ ID NO: 417149 - DNA, 572 bp, Homo sapiens
  misc_feature: GZ8MTXP01CD98T.19.78.H01.1.454.CMB.2.raw
  modified_base (298)..(298): a, c, t, g, unknown or other
  modified_base (358)..(358): a, c, t, g, unknown or other
  modified_base (374)..(374): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgatgttagaaattctaacttgtctctgtacacatacaaccaaataacgccccaaactcatcatttangatcgccactaagcgccctgagggtttcaatcgcttctcctggctcaagtctagacaacncgcctcctgacaatcnctggctcgagctgaggacgaggctgtattacgtatgctggcttacgatactgctaggtcgttatctcttagtcgttcgttcggaacgttcgggtaacccaagggttaccctaccggttccgttaacgggttccctaaaccgggacccccgtaaacgggaccccaaaacccccgttcgttaaccgttccgttaaccccg

SEQ ID NO: 417150 - DNA, 545 bp, Homo sapiens
  misc_feature: GZ8MTXP01CPXX9.19.78.H01.1.454.CMB.2.raw
  modified_base (231)..(231): a, c, t, g, unknown or other
  modified_base (261)..(261): a, c, t, g, unknown or other
  modified_base (277)..(277): a, c, t, g, unknown or other
  modified_base (358)..(358): a, c, t, g, unknown or other
  modified_base (442)..(442): a, c, t, g, unknown or other
  modified_base (529)..(529): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtnatgtgaaattctaacttgtctctgtaccanatcacccaaataaacnccccaaatcatcatttatgatgccactaagcgccctgagggtttctaatcgcttctcctggctccaagtctaggaccaacncggccctccctagaccaatctctcgggctccaggctgaggacgagctgattacactgctggctcatatgcgtaggtctatcttnttagtcgttcgttaacggaacgttgggtaaccaagggttccaccgttccgttagggttaccaacggaccccaacggacccaaccccnctaacgttcctaaccc

SEQ ID NO: 417151 - DNA, 633 bp, Homo sapiens
  misc_feature: GZ8MTXP01A3N6Q.19.78.H01.1.454.CMB.2.raw
  modified_base (263)..(263): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacaanatcaaccaaataacgccccaaactcatcatttatgatcgcactaagcgccctcgagggtttctaatcgtcttctcctcggtcctacgtacgtcgtacgaccaacgccgtccctaccacgaactactcgtcgtcggcctacggacgtcgtacggacgggaaacggcgtacgtacgttaaccttaacttacgtcgtcgtacgtactacttaagtagtacggtacgtacggttacgttaactttcctttagtttaacggttcgttaccggttaacgggtaacggttacggtaaacccgttcgtacccgtaaccggttaccgttacgacgaacccgaccgaaccgtaccccgaccttcgtcgttaacgttcccc

SEQ ID NO: 417152 - DNA, 585 bp, Homo sapiens
  misc_feature: GZ8MTXP01CEAPS.19.78.H01.1.454.CMB.2.raw
  modified_base (302)..(302): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggtccagtctgccctgactcagtctgcctccgtgtctgggtctcctggacagtcggtcaccatctcctgcactggaaccagcagtgatgttagaattctacttgtctctgtaccaacatcaccaaataaacgccccaaactcatctactttatnatgccactaacgcggccctctaggggtttctaatcgcttctcctggctccagtctaggcaacgacgcctcctgacactctcgtcggctcgagctgacggacgaggctaggtattactactgctggctcatatgctaggtcgtattcttacttagttcgttcgttaaccggtaacgttacgggaacccgttaaacggttcccgtaacccggttaccgttcgggttcctaaccggaccccgtaacgggaccccaaaccccgttacttccgttaacgttaaccccg

SEQ ID NO: 417153 - DNA, 521 bp, Homo sapiens
  misc_feature: GZ8MTXP01BNL5I.19.78.H01.1.454.CMB.2.raw
  modified_base (299)..(299): a, c, t, g, unknown or other
  modified_base (450)..(450): a, c, t, g, unknown or other
  modified_base (510)..(510): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcacccaaataaacgcccccaaatcatcatttangatgccactaagcgccctgtaggggtttctaatcgcttctcctggctccaagtctacgggcaacaccggccctccctgacaatctctgggctccgaggctggaggacgaggctgattacactgcctgggctcatactgctaggtctatctnttatgtctggaacttgggaccaaggtcaccgttcgttgttcaacgcccaagcccaacccntcgttctaacc

SEQ ID NO: 417154 - DNA, 605 bp, Homo sapiens
  misc_feature: GZ8MTXP01EY2NF.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctggtaccaacatcacccaaataaacgccccaaactcatacatttatgatcgaccaactaagccggccctcgtaggggtttctaatcgcttctcctggctccaagtcctaggacaacgaccggtccctccctgaactaactcttcgtcgggtcctaccgaggcctggaggaacgagggtactggaacttactactggtctcgggcttacgatatgcgtaagggttcctaattcttctttaagtcgttacgttaacgggtaacgttcggggaaaccttaaggtccctaaccggttacccgttagggttccaacgacccgaacggccccaaaccccttctaacggttctaaccc

SEQ ID NO: 417155 - DNA, 602 bp, Homo sapiens
  misc_feature: GZ8MTXP01DNL9L.19.78.H01.1.454.CMB.2.raw
  modified_base (296)..(296): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacacatacaaccaaataaacaccccaaatcatcatttangatgaccaacgtaacgccggtccctacgtacgggtttactaaacttccgtcttctcctcggacttaccgaagtctaggaccaaccgaccggtccctccctagacctaactctcgtcgggctaccgaggctaggaggacggagctagattacagtgctggactctatacgtgcgtacggttctacttcttacttagttcgttacgttaacggaaacgttcgggaaaccttaacggtccgtaaccgttcgttacggaccaaccgaccccgtaaacggaccccaacccgttactcgttcccgtaacccg

SEQ ID NO: 417156 - DNA, 512 bp, Homo sapiens
  misc_feature: GZ8MTXP01EHBPT.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataaagccccaaactcatcatttatgatgccactaagcgccctcaggggtttctaatcgcttctcctggctcaagtctggcaacacggcctccctgacaactctctggctcaggctgaggacgaggctagattactatgctggctcatatgcaggtctatctcttatgtcttcgggaacttgggaccaaaggtctaccgttccttggttcaacgcccaaggacccaacccactcgttctaacc

SEQ ID NO: 417157 - DNA, 597 bp, Homo sapiens
  misc_feature: GZ8MTXP01BFKH4.19.78.H01.1.454.CMB.2.raw
  modified_base (265)..(265): a, c, t, g, unknown or other
  modified_base (282)..(282): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtaccaanatcaacccaaataaacnccccaaactcatcaatttatgatcgccaactaacgccggccctcgtagggtttctaatcgcttctcctggctacaagtctggacaacgcgccctccctagacaatctctggctcaggctgaggacgaggtctgacttactacgtgaccttgggactcgtaatagtgccgtaaggtcttaattcttcttagttcgttacgttaacggtaaacgttcgggggaaaccttaagggttaccctacccggttacgttacgggttccaaaccggtaccccgaaacggacccccaaccccttaccgtcgttccctaaccccg

SEQ ID NO: 417158 - DNA, 600 bp, Homo sapiens
  misc_feature: GZ8MTXP01AB6AT.19.78.H01.1.454.CMB.2.raw
  modified_base (297)..(297): a, c, t, g, unknown or other
  modified_base (359)..(359): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatacaccaaataacacccccaaactcatcatttangatgccactaacgcgccctgtagggtttctaatcgcttctcctggctccaagtctagcaacncggccctcctacgacaatctcgtcgggcctccgaggctaggaggaccgaggctagactttacactgcctggctacatacgtcgtcgtaaggttcgttaattccttctttaagtcggttaccgtttaacgggaaacgttcggggaaccttaaacgggttccctaaacccggttcgttaacgggttcccaaccgtaccccgaacgggtcccccaaacccccgttacgtccgttaaccgtcccg

SEQ ID NO: 417159 - DNA, 606 bp, Homo sapiens
  misc_feature: GZ8MTXP01BZX48.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaattctaacttgtctctggtaccaacatcaaccaaataaacgaccccaaactcatactatttatgatcgaccaactaacgccggtcccttcgtaggggtttctaaatcgtcttctccctggtctaccaagtctaggaccaacgaccggtccctccctagaccaactctcgtcggctccgaggctagaggacgagggtctgtacttactactgtctggcttactatacgtgacgtaggttctattcgtctttatcgttcgttcggtaaacgttcgggggaaacccttaagggtcccgtaccgttaccgttcgggttaccaaccggaccccgaacggaccccaaccccttacgtccgttccttaaccccg

SEQ ID NO: 417160 - DNA, 576 bp, Homo sapiens
  misc_feature: GZ8MTXP01AO8BT.19.78.H01.1.454.CMB.2.raw
  modified_base (272)..(272): a, c, t, g, unknown or other
  modified_base (290)..(290): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcacatctcctgcactggaaccagcagtgatgttagaaattctactgtctctgtacacatcaccaaataacnccccaaatcatcatttangatcaccactaagcgtccctcgtaggggtttctaatcgtcttctcctggctcaagtcgtaggacaacacgcctccctagacatctcgtggctcgagtcgtaggacggacggtagctacgattaactctgctgggcttatactagtcgcgtaggtcgttatcttacttagttcgttccgtaacggtaacgttacggggaaccttacggtaccgtaccgttccgttcggttaccgaacggtccccgaaacggttcccccaacccgttacgttccgttaaccttccccg

SEQ ID NO: 417161 - DNA, 507 bp, Homo sapiens
  misc_feature: GZ8MTXP01ENW8Z.19.78.H01.1.454.CMB.2.raw
  modified_base (296)..(296): a, c, t, g, unknown or other
  modified_base (313)..(313): a, c, t, g, unknown or other
  modified_base (352)..(352): a, c, t, g, unknown or other
  modified_base (410)..(410): a, c, t, g, unknown or other
  modified_base (466)..(466): a, c, t, g, unknown or other
  modified_base (491)..(491): a, c, t, g, unknown or other
  modified_base (499)..(499): a, c, t, g, unknown or other
tcagtactctcgtgcacgaccggtgctcgatttagtgtgagtagtttgggtttgggggggtcacaagaggcagcgctctcgggacgtttccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgctctgtacaacatcaccaaataaacgccccaaatcatcatttangatgccataagcgcctntagggtttcaatcgcttctctcgctcaagtctgacaacncggcctccagacatctctgggctcaggctgaggcgaggctgattacgactgctgcttnatatgctaggtctatcttcttatgtcgtcggaactgggaccaagttccgaccgtcngttcacgcccaaggccaacccgtancgtaaccncgttcccg

SEQ ID NO: 417162 - DNA, 597 bp, Homo sapiens
  misc_feature: GZ8MTXP01B1RIC.19.78.H01.1.454.CMB.2.raw
  modified_base (220)..(220): a, c, t, g, unknown or other
  modified_base (259)..(259): a, c, t, g, unknown or other
  modified_base (300)..(300): a, c, t, g, unknown or other
  modified_base (343)..(343): a, c, t, g, unknown or other
  modified_base (374)..(374): a, c, t, g, unknown or other
tcagtactctcgtgcacgaccggtgctcgatttagtgtgagtagtttgggtttggggcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccngcagtgatgtagaaattctaacttgtctcctgtaccaanatacaacccaaataaacgaccccaaaactcaatcaatttangatgaccaataacgcgccctcgagggtttctaatcgcttctcnggctccgaagtctaggacaacacgcctcccngaacatctctcggctccgagctagacggacgaggctagaacttacacttgccttgtactactatagtcgcgttaggttcttacttcttacttagttcgttaccgttaacggtaacggttacgggtaaacccgttaacggttacccgtaacccgttaccgttacggttaccgaaccgaaccccgaaaccgaccccaaaccccgttacttccgttccgtaacccg

SEQ ID NO: 417163 - DNA, 756 bp, Homo sapiens
  misc_feature: GZ8MTXP01CRBK4.19.78.H01.1.454.CMB.2.raw
  modified_base (269)..(269): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctagtaccaacatacaaccaaataacgaccccaaatcatactattangatcgaccaacgtaacgccgaccctgtacgggttactaatcgtacttctcgtcggctaccgaagttcgtacggaccaaaccgaccggtaccctacccgtagaacctaactccccgttcggcggggtccctaccgaaggaccgtagggaacggacgtagggtactacggtacttaactactcgtacctcgaccttataagtacgttacggacgttacgggttacttaactttccttaaccgttttaagttccgtttaaccggtttaacgggggtaaaccggttaccggggtaaacccttaacgggtacccgtaaccccggttacccgtacgggtaaacccacccggtaacccctaaacccgggaccccctaaaacccctcgttaccgttacctaacccgttcccgttaccccgttacccccttacccccgttccaacccgtaacggtaacgtaacgtaacccgtgggaccgtccggggcgtaaccggg

SEQ ID NO: 417164 - DNA, 671 bp, Homo sapiens
  misc_feature: GZ8MTXP01BC0Q3.19.78.H01.1.454.CMB.2.raw
  modified_base (193)..(193): a, c, t, g, unknown or other
  modified_base (220)..(220): a, c, t, g, unknown or other
  modified_base (256)..(256): a, c, t, g, unknown or other
  modified_base (282)..(282): a, c, t, g, unknown or other
  modified_base (287)..(287): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctctggacngtcgtcacatctcctgcactggaaccngcagtgatgttagaaattctaactgtctctgtacanatacaccaaataacgcccaaatcatnattangatgaccaatagcgccctcgtagggtttactaactcgtacttctcgtcgtctcaagtctacgacaacgtacgccctccgtgactaactctcgtacggctacgaggctacggaacggacgtacgtacgtacggtaacttaccgtaacgtcgtccgttaggaccgttcgttaaacgttacgtacggtacccgtagggtttaccttacgttactttaccgttaacgtttccggttaccgtttaaccgggtaaacgttaccggggtaaacccttaaacggggttacccttaacccgggttaccgtttaacgggacccttaaaccggaccccgtaaaccgggtaaccccctaaacccgttaccgttaaccgttaaccccggttaacccg

SEQ ID NO: 417165 - DNA, 581 bp, Homo sapiens
  misc_feature: GZ8MTXP01CZWNR.19.78.H01.1.454.CMB.2.raw
  modified_base (470)..(470): a, c, t, g, unknown or other
  modified_base (565)..(565): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgtagaaattctaacttgtctctgtaccaacatcaccaataaacgccccaaactcatcatttatgatcgaccactaacgcggccctcgtagggggtttactaatcgcttctcctggctccaagtctacggacaacgacggtccctaccctagactaactctcgtcgggtctaccgagggctggaggacggaggctagattactactgctggctctaatatgctaggtcgttactcttnttagtcgttcgttaacggtacgttcgggaaccgttacggtccgtaccgttccgttacggttaccgaacgacccgaacggtacccaaccccgttcncgtttttccgaacccg

SEQ ID NO: 417166 - DNA, 572 bp, Homo sapiens
  misc_feature: GZ8MTXP01DMH1L.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgattgttagaaattctaacttgtctctgtaccaacatcaaccaaataaacgaccccaaactcatcattatgatgaccactaagcggccctcgtaggggtttactaatcgcttctcctggctccaagtctagggacaacgacggccctaccctgaccaatctactcgggctcgaggctggaggacgaggctagtattactactgactgggctactatactgctaggtcgttaattcttcttattcgttcttaacggaacgttcgggtaacccaaggttccacccggttcgttcggttaccaaccggacccaaaccggccctaaccccactcgccttaaccc

SEQ ID NO: 417167 - DNA, 559 bp, Homo sapiens
  misc_feature: GZ8MTXP01CVEAX.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtacaacatcaaccaaataaacaccccaaactcatcattatgatgaccaactaacgccgtccctcgagggtttctaatcgcttctcctggctcaagtctacggaccaacgaccgccctaccctagacctaatctcgtcgggctaccgaggctaggaggacgaggctagtacttactactgctcggtactctatagtgacgtaggtcttatctcttatcgtcgttaacggaacgttcgggaccttacggtccaccgttaccgttcggttccaacgacccgaacgacccacccactcgttcctaacc

SEQ ID NO: 417168 - DNA, 556 bp, Homo sapiens
  misc_feature: GZ8MTXP01E3E34.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctggtaccaacatacaaccaaataaacgccccaaactcatcatttatgatgccactaagccggccctcgtaggggtttctaatcgtcttctcctggctaccaagtctagggaccaaccgaccggccctccctagacaactctcgtgggctccgaggctaggaggacgaggctagattactactgctggctcatatgacaggtcgtatctcttatcgttcttcggaacttcgggaaccaaaggtcctaccgttccgttaggttccaacgccccaacggccccaacccactcgttcctaaccg

SEQ ID NO: 417169 - DNA, 655 bp, Homo sapiens
  misc_feature: GZ8MTXP01B5DHK.19.78.H01.1.454.CMB.2.raw
  modified_base (259)..(259): a, c, t, g, unknown or other
  modified_base (292)..(292): a, c, t, g, unknown or other
tcagtactctcgtgcacgaccggtgctcgatttagtgtgagtagtttgggtttgggggtcacaagaggcagcgctcttgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctgacanatcaccaaataaacaccccaaatcatcatttangatcgaccaactaacgcgcctcgtagggttcaactcgcttctcctgactccaagtcgtacggaccaacgaccggtccctcccgtacgaactaaacgtcctacgtcgggtaccttaccgaacgggtcgtacggaacgggaccggtagggtaccttaggtacttaacgtaacgtgtccgtgggacttacacttaagtcgaccgtacgggttacgttaacttccgtttctttaacgttcggttaccgttaaccgggtaaacgttacgggggtaacccttaaacgggttacccacccgttaccgttacggttaccgaacgaccccgtaacggacccctaaacccttcgttaaccgttccgtaacccg

SEQ ID NO: 417170 - DNA, 554 bp, Homo sapiens
  misc_feature: GZ8MTXP01CG8ZG.19.78.H01.1.454.CMB.2.raw
  modified_base (266)..(266): a, c, t, g, unknown or other
  modified_base (299)..(299): a, c, t, g, unknown or other
  modified_base (360)..(360): a, c, t, g, unknown or other
  modified_base (421)..(421): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtaccaanatacaccaaataaacgccccaaatcatcattangatgaccactaagccgccctgtagggtttctaatcgcttctctgctcagtctaagacaacncgcctcctagacatctctggctcgagctagaggacgaggctagattactactgtctggctnatatgctaggtctatcttcttagtcgttcgttaacggtaacgttcggggtaaaccttagggtaccctaccgttcccgttaggttccaacggaccccaacggaccccaacccttcgttccgttcgttaaccccg

SEQ ID NO: 417171 - DNA, 795 bp, Homo sapiens
  misc_feature: GZ8MTXP01C8DYT.19.78.H01.1.454.CMB.2.raw
  modified_base (280)..(280): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtacaacatacaccaaataacnccccaaactcatcatttatgatcgaccaactaacgccggtaccccttacgacgggggttttactaacgtccgtctttcctcctcggtacctcccgtaaagtccgtacgggaccaaccgtaccggtccccttacccgtacgaacctaacttccgtcgtcgggccttccgaggcgtaggaacgggaacgacggtcttacggtaacttaacctacgtacgtccgttgggtaccttacctaaagttacgtacggtaccgttaacgggttccggtttaaacctttcccccgttttaaagtttccgggttacccgtttaaccgggggaaaaccggtttaccgggggttaaaccccggttaaaaacggggttcccccgtaaaccccgggggttttccccgttaaaccggggttcccgttaaaacccgggtaacccccccggtaaaaaccccgggaaccccccctaaaaacccccccgggtactttaacccgggttccccttaaccccgtttttccccccggg

SEQ ID NO: 417172 - DNA, 547 bp, Homo sapiens
  misc_feature: GZ8MTXP01DNDH5.19.78.H01.1.454.CMB.2.raw
  modified_base (429)..(429): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaaccagcagtgatgttagaaattctaacttgtctctgtacaacatacaaccaaataaacgaccccaaatcatcaatttatgatcgaccactaagcgtccctcgtagggtttctaatcgcttctctcgctacaagtctaggacaacgacgcctcctgacatctctggctccaggctagaggacgaggctagacttactactgctggctanatatgctaggtcttatcttcttagttcgtcgttaacggtaacgttgggtaaccgaaggttcctaccgttcgttcggttacaaccggaccaacggcccaacccgttctcgttcctaacc

SEQ ID NO: 417173 - DNA, 556 bp, Homo sapiens
  misc_feature: GZ8MTXP01B9QUH.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccacatcaacccaaataaacgccccaaactcatcatttatgatgccactaacgccggcccctcgtagggggtttctaatcgtcttctcctggctccaagtctaggccaacgacggccctccctgacaatctctcgggctccgaggctggaggacgaggctgattactactgctgggctcatagtgcgtaggttcgttatcttctttatcgttcgttaacggaacgttggggaccttaggtcctaccgttccgttaggttccaacgtacccaacggccccaacccgctcgttcctccc

SEQ ID NO: 417174 - DNA, 515 bp, Homo sapiens
  misc_feature: GZ8MTXP01C60N3.19.78.H01.1.454.CMB.2.raw
  modified_base (265)..(265): a, c, t, g, unknown or other
  modified_base (279)..(279): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaanatcaccaaataaanccccaaactcatcatttatgatgccactaagcgccctcagggtttctaatcgcttctcctggctcaagtctaggcaacacggccctccctgacaatctctgggctcaggctgagacgagctgattacactgctggctcatatgcaggtctaatctcttatgttctcggaacttgggaccttaaaggtcaccgttcttggttcaacgacccaacggcccaacccactcgttctaacc

SEQ ID NO: 417175 - DNA, 571 bp, Homo sapiens
  misc_feature: GZ8MTXP01ELNE9.19.78.H01.1.454.CMB.2.raw
  modified_base (261)..(261): a, c, t, g, unknown or other
  modified_base (276)..(276): a, c, t, g, unknown or other
  modified_base (296)..(296): a, c, t, g, unknown or other
  modified_base (456)..(456): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacantcaaccaaataaacnccccaaactcatctatttangatgaccactaagcgccctacgtaggggtttactaatcgcttctcctggctccgaagtctaggacaacgacggcctcccagacatctctggctaccgaggctgaggacgaggtctagattacgtactgcctgggctactatagtgcaggttctattcctnttagtgtccgttcggaacgttggggaacccttaaacgggtcctaacccggttccgttagggttacccaacggacccctaacgggaccccaacccccgttatcgttcccgtaaccc

SEQ ID NO: 417176 - DNA, 705 bp, Homo sapiens
  misc_feature: GZ8MTXP01BN3FA.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacgccccaaactcatctatttatgatcgaccaactaacgccggtccctacgtacgggggttttactaaacttccgtactttcttccctcggtaccttacccgtaaagttccgttaacgggaccctaaccgacccgggtccccttacccctacggaacctaaactccgttccgtcggggtcctaccgtagggccgttagggaacgggaacggacgggtctaggtaacttactacgtgtcctcgggtctactaattacgtcgtacgtacggttcgttaattccttctttacgttcgttaccgttaacgggtaacgttcggggtaaacccttaagggttaccctacccggttaccgttacggttacccgtaaccggaccccgaacggacccccgtaaccccgttaccttccggttaacccttaaccccg

SEQ ID NO: 417177 - DNA, 655 bp, Homo sapiens
  misc_feature: GZ8MTXP01DG1CD.19.78.H01.1.454.CMB.2.raw
  modified_base (265)..(265): a, c, t, g, unknown or other
  modified_base (428)..(428): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcacatctcctgcacgtggaaccagcagtgatgttagaaattctaacttgtctctgtaccaanactacaaccaaataacaccccaaatcatctattatagatcgaccaactaacgccgtaccctaggtacgggtttactaagtcgtcttctacctcggtactacctaagtccgtaacgaccaaccgaccgtccctccctagactactctcgtggcctccgaggtcnggagacgtgtcgtataacttactctgtacctcgggtactagtaactagtacgtcgtacggtcttaacttccgttatttacgttcgttaccgtaacgggtaaacggttcgggtaaaccgttacgggttaccctaaccgggttaccgttacgggacccctaacccgggaccccgaaaacccgggttacccccaaaacccttccggtaaccgttaacccgttaacccccg

SEQ ID NO: 417178 - DNA, 683 bp, Homo sapiens
  misc_feature: GZ8MTXP01CXETH.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaaccaaataaacgaccccaaatcatctaatttatgatcgcctaactaacgccggtcccttcgaagggggttttactaaatcgtcttctccgtcggactccaacgtctacgggacaaccgacggtcccctaccctagacctaattccgtcgtcgggtcctaccgacggtcgtaggaacgggaacggacggtaccttaggaactttaacgtaacgtcggtaccttacgggtccttaccgtaatttacgtacggacgtaacggggtttccgttaaacttccgtttacctttagttccggttaacgtttaaccgggtaaacgttcgggggtaaaccacgggttacccgtacccgttaccgttagggttaccaacgaccccgaacgtaccccaaacccttcttaacgttccgttaaccc

SEQ ID NO: 417179 - DNA, 567 bp, Homo sapiens
  misc_feature: GZ8MTXP01BO0FI.19.78.H01.1.454.CMB.2.raw
  modified_base (280)..(280): a, c, t, g, unknown or other
  modified_base (436)..(436): a, c, t, g, unknown or other
  modified_base (459)..(459): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaactgtctctgtacaacatcaaccaaataaacnccccaaactcatcatttatgatcgccaactaacgcggccctcgtaggggtttctaatcgcttctcctcggctccaagtctaacggcaaccgacggccctccctgacaatctctggctccgagctggaggacggagctagattactactgctggctnactagtgcgtaggtcgtattctnttattcgttcgttaacggaacgttacgggaaccttacggtacctaccgggggttacttacggttaccaacgacccgaacggaccccaaccccttactcgttctaaccc

SEQ ID NO: 417180 - DNA, 733 bp, Homo sapiens
  misc_feature: GZ8MTXP01DRZYB.19.78.H01.1.454.CMB.2.raw
  modified_base (224)..(224): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacatggtcctgggcccagtctgccctgactcagtctgcctcgtgtctggtctctggacagtcgtcaccatctcctgcactggaaccngcagtgatgttagaacttctaacttgtctctagtaccaacataccaaccaaaataaaccgacccccaaactcatactatttatagactacgacctacgtaacggcccggtcccgttacggtacggggttttactaacgtccgtcctttccctcgttcggtacctacccgtaaacggttccgtaccgggaacctaaaccgaccccgggtaccccttaccccgtagaacctaaacgttcccgttaccgtacggggtcccgttaccggacgggtaccgttaggggaaacggggaccggtaaacggtccgttaggtaaactttaccgtacgttcggacgttcgtacgttacctagttacgtcggtacgttacgggttactttacttcgtttactttaaggttcgttaacggttaaccggaacgttacggggaacccgtaagggtacccttaccggttcgttacggtaaccaccgaacccgtaaccggacccttaacccgtcgttcgttaaccc

SEQ ID NO: 417181 - DNA, 575 bp, Homo sapiens
  misc_feature: GZ8MTXP01BAEXG.19.78.H01.1.454.CMB.2.raw
  modified_base (263)..(263): a, c, t, g, unknown or other
  modified_base (287)..(287): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatcctcctgcactggaaccagcagtgatgttagaaattctaacttgtctctgaccanatacaaccaataaacgccccaaancatctatttatgatgccactaagcggccctcgtaggggtttctaatcgcttctcctggctaccaagtctagggaccaacaccggtccctccctagacctaactctcgtgggcctccgaggcgtggagggacgaggtctgacttactactgctcggtctcatagtcgacgtaggttcgtacttcgttctttagtcgttcgttaacgggaattcggggaaccttaaggtcctaaccggttcgttggttccaacgccccgaacggaccccaaccccactcgttcctaaccc

SEQ ID NO: 417182 - DNA, 566 bp, Homo sapiens
  misc_feature: GZ8MTXP01DFD1U.19.78.H01.1.454.CMB.2.raw
  modified_base (229)..(229): a, c, t, g, unknown or other
  modified_base (271)..(271): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccngcagtgattgttagaaattctaacttgtctctggtaccaacntacaaccaaataaacaccccaaactcatcattatgatgccactacgcgtccctcgagggtttactaatcgcttctcctggctcaagtctggacaacgccggtcctccctagaacaactctcgtaggctccgaggtcgtgaagggacgaggtctagattactatgctcggctagatatgcgtaggtctatcttacttattcgtcttaacggaacgttcgggaaacgaaggtaccacgttcgttacggttcaaccgacccgtaaacggcccctaaacccgctaaccgttctaacccg

SEQ ID NO: 417183 - DNA, 641 bp, Homo sapiens
  misc_feature: GZ8MTXP01E2DBG.19.78.H01.1.454.CMB.2.raw
  modified_base (226)..(226): a, c, t, g, unknown or other
  modified_base (232)..(232): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtnatgttagaaattctaacttgtctctgtaccaacatacaaccaaataaacgacccccaaactcaatcaatttatgatgaccactaagcggcccctgtacggggtttctaaatcgcttctcctggctccaagtctacgggacaaccaccgggccctcccgtagaacctaacgttcctccggtcggtacctccgacggcgtaggaacggtacggagtcctagtacttaccgtaacgtcgtactcggctactagtaacgtcggtcgtaggttacgttactttccttactttacgttcggttccgttaacgggtaacgttacgggaaaccgttaacggtcccgtaacccgttcgttacggttccaaccggaccgaaccggtaccccaacccttacgtcgttaacccgtaacccg

SEQ ID NO: 417184 - DNA, 744 bp, Homo sapiens
  misc_feature: GZ8MTXP01DHV5P.19.78.H01.1.454.CMB.2.raw
  modified_base (273)..(273): a, c, t, g, unknown or other
  modified_base (298)..(299): a, c, t, g, unknown or other
  modified_base (723)..(723): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgattgtagaaattctaacttgtctctgacacatcaaccaaanaaacgacccaaatcatctaatttannatcgaccaacgtaacgccgtcccgttacgtacgggtttactaagtcgtcttctcctcggtctcgtaacgtctaacggaccaaccgaccggtcccctacccgtacgaacctaacgttcgtaccggtcgggtcctacccggtaacggggtaccggttagggaaccgggggaaccgtaacggggtaccgttaaggttaacctttaaaccgtaccgttacgtccttacgggggtaccccttagtaaacgtttagtaccggtaacgtacggggtttacgtttaacttccgttttacgtttaacgtttcggttaaccggtttaaccgggtaaaccggttacgggtaaaccccgaaaggttaccccgtcccggttaacgttaccgggttacaacccggtaaccccgaaccggtacccccaaaaccccgttnttccggttccctttaaccccg

SEQ ID NO: 417185 - DNA, 616 bp, Homo sapiens
  misc_feature: GZ8MTXP01CMJD6.19.78.H01.1.454.CMB.2.raw
  modified_base (369)..(369): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcacgtggaaccagcagtgatgttagaattctacttgtctctgtacaacatcaaccaaataacgaccccaaactcatacatttatgatcgaccactaacgccggcccgttcgtagggggtttctaatcgtcttctcctggctcaagtctagcaacncgccctcctcgacatctctcggctccgaggctggaggacgaggctagtattactacgtgtctggactctaatagtgtaccgtaggttacgttacttcttactttagttcgttccggttaacggtaaacggttcgggaaacccgttaagggttacccgtacccggttacgttacggttcccgtaaccggaccccgtaaaccgggacccctaaacccccgttacgttcccggttaacctttaacccccg

SEQ ID NO: 417186 - DNA, 612 bp, Homo sapiens
  misc_feature: GZ8MTXP01BT45O.19.78.H01.1.454.CMB.2.raw
  modified_base (231)..(231): a, c, t, g, unknown or other
  modified_base (261)..(261): a, c, t, g, unknown or other
  modified_base (295)..(295): a, c, t, g, unknown or other
  modified_base (316)..(316): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtnatgttgaaattctaactgtctctgtacaanatcaccaaataacgcccaaactcatacatttacngatgccaactaagcgaccctntagggtttctaatcgcttactcctggctccgaagtctacggactaacgaccggccctaccctcgaactaactctcgtgggctccgaggctggaggacgaggctagtattactatgctggctcgatatgcgagttgtactctcgttattcgtcgttaacggtaacgttagggaacccgttaaacggttaccgtaacccggttacccgttacgggttacccgtaaaccggtacccccggtaaaacccgggaaccccctaaaccccttaaccgtttaaccggttaacccgttaaccccg

SEQ ID NO: 417187 - DNA, 739 bp, Homo sapiens
  misc_feature: GZ8MTXP01BYW4H.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacacatcaaccaaataaacgccccaaactcatctatttatgatcgaccactaacgcggccctacgtaggggtttactaatcgtcttctcctcggctaccgaagtcgtacggaccaaccgaccgggtccctacccgttagaacctaactccgtacgtcggggtacctacccggaagggtcgtagggaacgggtaaccggacgggtacgttaggtaactttaaccgttaacgttcggtaccttaggggtcccttacgtaattaacgttcggtaccgtaacgggtttaccggttaactttcctttactttaacggttttcggttcccgtttaaacgggggtaaacccggttccggggtaaacccggttaaacggttaccccggttaacccggttacccgttacgggttacccgtaaccggaacccccgtaaacccggggtaccccctaaacccccggttcttccggttaacccgtttaaccccg

SEQ ID NO: 417188 - DNA, 580 bp, Homo sapiens
  misc_feature: GZ8MTXP01AYC5G.19.78.H01.1.454.CMB.2.raw
  modified_base (324)..(324): a, c, t, g, unknown or other
  modified_base (445)..(445): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgagcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgcccccaaaatcatcatttatgatgccactaagcgccctnagggtttctaatcgcttctctggctccaagtctggcaaacacgtcggccctccagactaatcctcgtcgggactcgagtctaggaggacgaggctagtattactactcgggacttgcctanaatatcgctaagggtctaattctcttaatcgttacgttacggaacgttcgggtaaaccgtaacggttccgttacccgttacgtaagggtaccaaccgacccgaaacgggaccccctaaccccttaacggttcccg

SEQ ID NO: 417189 - DNA, 606 bp, Homo sapiens
  misc_feature: GZ8MTXP01D79RW.19.78.H01.1.454.CMB.2.raw
  modified_base (197)..(197): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcactggaaccagcagtgatgtgaaattctaactgtctctgtacaacatcaccaaataaacgccccaaactcatcatttatgatgccaactaagcggccctcgtaggggtttctaatcgcttctcctcggctaccaagtcctaacgtaccaacaccggtccctccctagacaatctacgtgggctccgaggctggacgacgaggctgatactactgccttggctcgtattagtcgtacgtacggttcgttattcccttagtttacttcgttcgtttaaccgggaaacgtttccggggaaaccttaaacggtccctaaccggttaccgttacgggttaccaaccggaccccgaacggtaccccaaaaccccttcgtaacgttccgttaaccccg

SEQ ID NO: 417190 - DNA, 513 bp, Homo sapiens
  misc_feature: GZ8MTXP01BNH29.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctgtacaacatcacccaaataaacgccccaaactcatcatttatgatgccaactaagcgccctcgtaggggtttctaatcgcttctcctggctccaagtctacggctaacgaccggccctccctgacctaatctctgggctccaggctgaggacgaggctgattactactgctggctcatatgcaggtctatctcttatgtctcgacttggacagtcacgttcgttagttcaagcccaacggcccaccactcgttctaacc

SEQ ID NO: 417191 - DNA, 551 bp, Homo sapiens
  misc_feature: GZ8MTXP01DDUSN.19.78.H01.1.454.CMB.2.raw
  modified_base (197)..(197): a, c, t, g, unknown or other
  modified_base (265)..(265): a, c, t, g, unknown or other
  modified_base (336)..(336): a, c, t, g, unknown or other
  modified_base (367)..(367): a, c, t, g, unknown or other
  modified_base (422)..(422): a, c, t, g, unknown or other
  modified_base (440)..(440): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatctcctgcactggaaccagcagtgatgttagaaattctaacttgtctctgtaccaanatacaccaaataaacgccccaaactcatcattatgatgaccactaacgcgccctgagggtttactaatcgnttctctggctcaagtctgcaacacgcctccngacatctctggctccgaggctgaggagaggctgattacactgctggaatcaatangacgtgtcgttatccttntttagtcgttcttaacgggaacgttggggtaaccaggtacctaccgttaccgttggttaccaacggaaccccgaacggtaccccaaccccgacgttcgaaccgttaacccg

SEQ ID NO: 417192 - DNA, 694 bp, Homo sapiens
  misc_feature: GZ8MTXP01B6Y2T.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctgtacacatacaaccaaataaacgaccccaaactcatctatttatgatcgaccaactaacgccggtccctacgtacgggggtttactaatcgtcttctcccgtcggtctaccgtaagtcgtaacggaccaaccgaccgggtccctacccgtagaacctaactcgtccgttacggggtccctccggacgggcctagggacgggtaacggacgggtacgttaggtaactttaccgtacgtcgtccttcgggtaccttacgtattaacgtcggtacgtacgggttacgttaacttccttactttagttccggttccgttaaccgggtaacgttacggggtaacccgttaacggtacccgtacccggttaccgttacgggttacccgaaccggaccccgaaccgggtacccccaaccccgttacgtccgttccttaaccccg

SEQ ID NO: 417193 - DNA, 507 bp, Homo sapiens
  misc_feature: GZ8MTXP01CMSIK.19.78.H01.1.454.CMB.2.raw
  modified_base (473)..(473): a, c, t, g, unknown or other
  modified_base (497)..(497): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcatggaaccagcagtgatgttgaaattctaactgtctctggtacaacatcacccaaataaagcccccaaactcatcatttatgatgccactaagcggccctcagggggtttctaatcgcttctcctggctcaagtctggcaacacggccctcctgacaatctctgggctcaggctgaggacgaggctgattactactgctggctcatatgcaggtcgtatctcttatgtcttcggacttggggaccaaggtcacgttcnggttcaagcccaaggcccaacccnctgctaaccg

SEQ ID NO: 417194 - DNA, 710 bp, Homo sapiens
  misc_feature: GZ8MTXP01D7XHH.19.78.H01.1.454.CMB.2.raw
  modified_base (260)..(260): a, c, t, g, unknown or other
  modified_base (276)..(276): a, c, t, g, unknown or other
  modified_base (295)..(295): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacanatacaccaaataaacnccccaaactcatcatttangatcgaccactaacgccgccctgtacggggtttctaatcgtcttctcctggactccaagtcgtacggacaaccgaccggtccctacccgtagaacctaactccgtcgtcggggaccttccgaaggtcctaggaacggaacggaggtcctagtaacttaacgtacgttggtccttggggtaccttactaagttaacgtcggtacccgtaaggggtttccgttaaacttcctttacccgtttaagtttcggttacccgtttaaaccgggtaaaccggttccgggggtaaacccttaaacggggttccccgtaaaccccgggttacccggttaacgggttaccccgtaaccgggtacccccgaaaccgggtaacccccctaaaccccgttaacgttccggttaaccctttaaccccgg

SEQ ID NO: 417195 - DNA, 562 bp, Homo sapiens
  misc_feature: GZ8MTXP01A7VZ1.19.78.H01.1.454.CMB.2.raw
  modified_base (324)..(324): a, c, t, g, unknown or other
  modified_base (461)..(461): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcagtgatgttagaaattctaacttgtctctgtaccaacatcaaccaaataaacgacccccaaactcatcatttatgatgccactaagcgtccctnagggtttctaatcgcttctcctggctccaagtctaggcaacaccggcctccctgacaatctcgtgggcctccgaggctggaaggacgaggtctgattactactgactggctctaatcgtgctagggttctattcttntttatcgttcgttaacggaacgttgggaaccaaggtccaaccgttccgttgggttccaacgacccgaacggtaccccaacccttacgtcgttcctaacccg

SEQ ID NO: 417196 - DNA, 650 bp, Homo sapiens
  misc_feature: GZ8MTXP01CZ8CC.19.78.H01.1.454.CMB.2.raw
  modified_base (262)..(262): a, c, t, g, unknown or other
  modified_base (295)..(296): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcacgtcggaaccagcagtgatgttagaaattctaacttgtctctgacanatacaaccaaataacacccaaatcatctattannatcactaacgtacgccgtaccctcgtagggtttactaactcgtcttctccgtcggtactcgaagtccgtaacggaccaacccgaccgtcccctacccgtacgaacctaacttcgtcgtcgggaccctccggaggacgtagggtaacgggacggtacgggtacttacggttaacttaccgtacgttcggtccttacgggtacctctaagtacgtcgtacgtaacggtttccgttaattcgtttacttagttcgttcgtaacggtaacgttacggaccgttaacggtcctaccgttacgttcgttaccgaacgtacccctaacggacccctaccccgttactccgttctaaccccg

SEQ ID NO: 417197 - DNA, 561 bp, Homo sapiens
  misc_feature: GZ8MTXP01D9QR4.19.78.H01.1.454.CMB.2.raw
  modified_base (281)..(281): a, c, t, g, unknown or other
  modified_base (300)..(300): a, c, t, g, unknown or other
  modified_base (432)..(432): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacaacatacaaccaaataaacnccccaaatcatcaatttangatcgccaactaacgcgccctagtagggttactaatcgcttctctggctacaagtctacgacaacgacgccctccagacatctcgtgctcgagcgtagaggtacgaggctgtaattacctatgctgacttanatgcgtcgtacgttacttacttcttcttacgtcgttacgtaacggaacgttacggaacgttacgtaccgtaccgttacgttacgaccaaccgtacccgaaccgacccctaaccgttctccgttcctccg

SEQ ID NO: 417198 - DNA, 662 bp, Homo sapiens
  misc_feature: GZ8MTXP01DFCEC.19.78.H01.1.454.CMB.2.raw
  modified_base (195)..(195): a, c, t, g, unknown or other
  modified_base (259)..(259): a, c, t, g, unknown or other
  modified_base (293)..(293): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcacatctcctgcactggaaccagcagtgattgtagaaattctaactgtctctgtacaanatcaaccaaataaacgccccaaatcatcatttangatcgaccactaacgcgtccctagagggtttctaatcgcttctccgtggctcaagtctaggacaacgacgtccctccctgactaatctcgtggctccgaggctaggacgggacgagggtctagtaacttacctacgttcgccttgggaccttactaagttacgtcggtcgtaacggggttcctttaaactttccgtttaccttttaagtcgggttttaccccgtttaacggggtaaaccgttacgggggtaaacccgttaaacgggttaccccgtaaccccgggtttacccggttccgggttaccaacccgtacccccggaaaccgggtacccccaacccccgttaactccggttaacccttaaccccg

SEQ ID NO: 417199 - DNA, 603 bp, Homo sapiens
  misc_feature: GZ8MTXP01BP8J2.19.78.H01.1.454.CMB.2.raw
  modified_base (263)..(263): a, c, t, g, unknown or other
  modified_base (293)..(294): a, c, t, g, unknown or other
  modified_base (362)..(362): a, c, t, g, unknown or other
  modified_base (443)..(443): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcacgtggaaccagcagtgattgttagaaattctaacttgtctctgaccanatcaccaaataacgcccaaatcatcattannatcgccactaacgcgcctcgtagggttctaatcgcttctctggctcaagtctcgcaacgcgccctccngacatctctacgggctccgaggcgtaggacggaacggacgggtctaggaacttactacgtcgtctcggcttacagttacgnggtcgagggttcgttaacttcgttactttaagtcgtttacggtaaccggttaacgttacggggtaaccttaaacgggttacctacccggttacccgttacggaccgaaccgtaccccgaacggttaccccaaacccgttcgtcgttaaccgttaaccccg

SEQ ID NO: 417200 - DNA, 616 bp, Homo sapiens
  misc_feature: GZ8MTXP01BWPNC.19.78.H01.1.454.CMB.2.raw
  modified_base (278)..(278): a, c, t, g, unknown or other
  modified_base (295)..(295): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctgtacaacatcaaccaaataacnccccaaatcatcattangatgaccatacgccgccctgtagggtttctaatcgcttctcctgctacagtctacgacaacgcgccctcctacgactactctcgtcggctcgaggctagaggacgaggctagtacttacgtacgtgtcgtggtctacgtattactcgacgtacggttcttacttcttacgtttagttcgttccgttaacgggtaaaccgttcggggtaaacccgttaaacgggttcccgtaacccggttaccgttaacgggttacccgaaccgacccccgtaaacgggaccccctaaacccgttaccgttccggttaaccccgttaacccg

SEQ ID NO: 417201 - DNA, 514 bp, Homo sapiens
  misc_feature: GZ8MTXP01AYBHS.19.78.H01.1.454.CMB.2.raw
  modified_base (265)..(265): a, c, t, g, unknown or other
  modified_base (429)..(429): a, c, t, g, unknown or other
  modified_base (503)..(503): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacaanatcaccaaataaacgccccaaactcatcatttatgatgccactaagccggccctcgtaggggtttctaatcgcttctcctggctcaagtctaggcaacacggcctccctgacaatctctgggctcaggctgaggacgagctagattactactgctggctcatangcaggtctatcgtcttatcgtctcgacttcgggacaggtcacgttcgttgttcaacgcccaacggcccacccgntcgctaacccg

SEQ ID NO: 417202 - DNA, 555 bp, Homo sapiens
  misc_feature: GZ8MTXP01BAC69.19.78.H01.1.454.CMB.2.raw
  modified_base (377)..(377): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttaggaaattctaacttgtctcctggtacaacatacacccaaactaaacgcccccaaactcatcatttatgatgccactaagcgccctcgaggggtttctaatcgtcttctcctggctcaagtctaggcaacacggccctcccngacaatctcgtgggcctccaggctgaggacgaggctgattactactgctcggctcatagtgcgtagtcgttaactcttcttatcgtacgttcggaacgttgggaccgaacggtcctacccgttccgttgggttccaacgaccccaacggccccaaccccgttactcgttaacctcccg

SEQ ID NO: 417203 - DNA, 545 bp, Homo sapiens
  misc_feature: GZ8MTXP01DOS5M.19.78.H01.1.454.CMB.2.raw
  modified_base (197)..(197): a, c, t, g, unknown or other
  modified_base (335)..(335): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatctcctgcactggaaccagcagtgatgttagaaattctaacttgtctctgtacaacatcaccaaataaagccccaaatcatcatttatgatgaccactaagcggcccttcgaggggtttctaatcgnttctctcggctccaagtctaggacaacgcgcctccctgacaatctctgggctccgagctgagacgaggctgattacactgactggctcatatgctagtccgtatctctttatcgttcgttcggaacttgggacccttaaaggtccgccgttaccgttcggttaccaacggtcccaaacgggtccccaaacccttcgttcgttccttaacc

SEQ ID NO: 417204 - DNA, 669 bp, Homo sapiens
  misc_feature: GZ8MTXP01BPSH5.19.78.H01.1.454.CMB.2.raw
  modified_base (320)..(320): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctggtaccaacatcaccaaataaagccccaaactcatcatttatgatgccactaacgcggccctntagggggtttctaatcgcttctctggctaccaagtctagggcaacacggcctccctgacaatctctgggctccaggctgaggacgaggctagacttacgtactgcctagggctctaatacttgaccgtaagggtccgttaattcccttagtttaacttcggtttccgttaacggggtaaaaccgtttcgggggtaaaaccccgttaaacggggttacccgtaaaccccgggtttaccccgtttaacgggggttacccctaaaccgggtacccccccgtaaaaaccgggggtcccccccaaaaaccccccgggttacccctttaaccggttaaccccgtttaaacccccg

SEQ ID NO: 417205 - DNA, 540 bp, Homo sapiens
  misc_feature: GZ8MTXP01DD7RN.19.78.H01.1.454.CMB.2.raw
  modified_base (261)..(261): a, c, t, g, unknown or other
  modified_base (277)..(277): a, c, t, g, unknown or other
  modified_base (413)..(413): a, c, t, g, unknown or other
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgacanatacaccaaataaacnccccaaactcatcaatttatgatcgaccaactaacgccggccccttcgtagggggttttctaatcgcttctcctggctcaagtctacggacaacgcgccctccctagacatctctggctcgagctggaggacgagntgattacatgctggctcatangcgagttcgtaattcttcttatcgttcttaacggaacgttacgggaccttaaggtcctacgttcgttcgttcaacgacccaacggaccccacccactcgctaaccc

SEQ ID NO: 417206 - DNA, 634 bp, Homo sapiens
  misc_feature: GZ8MTXP01DTE0D.19.78.H01.1.454.CMB.2.raw
  modified_base (299)..(300): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatctcctgcactggaaccagcagtgatgttagaaattctactgtctctgtacaacatacaaccaaataaacgaccccaaactcatcatttannatcgacaactacgccggccctcgtagggtttactaatcgtcttctcctcggactacctaagtccgtaagaccaaccgaccggtccctaccctacgaactaactcgtcgtcggggccttaccgaggtcctaggaacgggacggtagtccgtagtaacttactacgtgtacctggtactactaatacgtcgcgtacgggttcttaattcttactttagttcgttcgtttaacggaaacggttcgggtaaaccgttaaacggtaccgtaccgttaccgttacggttccgaaccgaccccaacggaccccaaacccgttcgtcgttaacccgttcccg

SEQ ID NO: 417207 - DNA, 624 bp, Homo sapiens
  misc_feature: GZ8MTXP01DQ3SA.19.78.H01.1.454.CMB.2.raw
  modified_base (196)..(196): a, c, t, g, unknown or other
  modified_base (274)..(274): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcgtcaccatctcctgcactggaaccagcagtgatgtgaaattctaacttgtctctgtacacatcaccaaataaacnccccaaactcatcatttatgatcgacactaacgcggccctcgagggtttctaatcgtcttctccgtggtactcctaacgtctacgggtacaaccgaccggtccctaccctacgactaatctcgtcggtctccgaggcgtaggacgggacgtaggcctagtaacttactacgtcgcttcggctactaatacgttcgcgtaacgggttcgttaattcgtttacttagttcgtttcgttaaccggtaaacgttcgggtaaacccgttaacggtccgtaaccgttccgttggttaccgaaccgaaccccgaaccggaccccaaaccccgttaccgtcgttaaccgttaaccccg

SEQ ID NO: 417208 - DNA, 552 bp, Homo sapiens
  misc_feature: GZ8MTXP01BFJTC.19.78.H01.1.454.CMB.2.raw
  modified_base (428)..(428): a, c, t, g, unknown or other
  modified_base (436)..(436): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaaccagcagtgatgttgaaattctaactgtctctggtacaacatcaccaaataaacgccccaaactcatcatttatgatgccaactaagccgccctcgagggtttctaatcgtcttctctggctcaagtctaggcaacacggcctccctgacaatctctggactcgagctggagacgagctgattactactgcttggctcatagtncgaggttntactcttcttagtcttcgttaacggaacgttcgggaaccgttaaggttccaacccgttccggttagttccgaacgccccgaaacggaccccaaaccccgacttccgttctaacccc

SEQ ID NO: 417209 - DNA, 743 bp, Homo sapiens
  misc_feature: GZ8MTXP01AVKO5.19.78.H01.1.454.CMB.2.raw
  modified_base (223)..(223): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcaccatctctgcactggaaccngcagtgatgttagaattctaacttgtctctgtaccaacatacaaccaaataaacgaccccaaactcatctaatttatgatcaccaactacgccgccctcgtagggtttactaatcgtcttctcctcggtctaccgtaagtctaacggtaccaaccgccgggtaccctcccgtacgactaaacttccgttacgtcggggaccttaccggaagggtccgtagggacgggaaccggtacggtactaggttaactttaccgtacgtcgtccgttacgggtctactaattaacgtcggtaccgttaaacgggttccgtttaacttccgtttaccgtttacgttcggtttacccggtttaaaccggggtaaaccgttaccgggggttaaaccccttaaacggggttaccccgtaaaccccggtttccccgttacggggttaacccctaacccggggtaaccccctaaacccggggaaccccccctaaacccccgttaccgtttcccggttaaccctttaacccccg

SEQ ID NO: 417210 - DNA, 627 bp, Homo sapiens
  misc_feature: GZ8MTXP01BDYPY.19.78.H01.1.454.CMB.2.raw
  modified_base (312)..(312): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaaccagcagtgattgttagtaaattctaaccttgtctcctagtaccaacactacaacccaaataaaccgacccccaaatcatactatttangatcgaccaactaacgccgccctagtagggtttctaatcgtcttcgtccgtcggctaccgtaagtcgtaacggaccaaccgcccgtccctacccgtgaacctatcctcgtcgggccttaccgaggcgtaggacggaaccggagacttagaattacctaaccgttgccttagggtctaactactacgttgccgtaggttaccttactcttcctttagtcgtttaccgtaaccggtaacgttcgggtaaccgttaacgggtccaccggttccgttacggccaacgacccgaacgaaccccaccgactcgaactcccg

SEQ ID NO: 417211 - DNA, 725 bp, Homo sapiens
  misc_feature: GZ8MTXP01DRE4F.19.78.H01.1.454.CMB.2.raw
  modified_base (278)..(278): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacaacactacaaccaaanaaacgaccccaaactcaatactatttatagatcgaccaacgtaacgtccggtaccctacgtacgggggtttacttaaacgttccgtctttcctaccgttcggtactcccgtaaagtcctaacggaccaacccgaccggcccttaccctagaactaacttcgtccgtcggcctccgtagggcctggaacgggacggtacgggtactagtaaaccttacgttaaccgtgtcgtacggggtctacgtaaattacgtagtacccgttagggttaccttactttcctttacctttaagttcggttaccgtttaaccggtaaacggttacggggtaaacccgaaacgggtaccccgttacccggttaccccggttaggttaccccgaaccggtacccccggtaaaccggacccccctaaacccttacccgttcggttaaccccgttaaccccg

SEQ ID NO: 417212 - DNA, 542 bp, Homo sapiens
  misc_feature: GZ8MTXP01E0XK4.19.78.H01.1.454.CMB.2.raw
  modified_base (441)..(441): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcgtcaccatctcctgcactggaaccagcagtgatgttagaaattctaaccttgtctctggtaccaacatcacccaaataaacgcccccaaactcatcatttatgatgccactaagcggccctcgtaggggtttctaatcgcttctcctggctccaagtctaggccaacaccggccctccctgacaatctcgtgggcctccagggctgaggacgaggctgattactactgctggctcaatcngccaggttctaatctcttatcgtcgtcggaacttgggaccttaagggtccaaccgttcgttagttcaacgcccaaggccccaacccgatccgttaactccc

SEQ ID NO: 417213 - DNA, 532 bp, Homo sapiens
  misc_feature: GZ8MTXP01EOUI1.19.78.H01.1.454.CMB.2.raw
  modified_base (431)..(431): a, c, t, g, unknown or other
  modified_base (435)..(435): a, c, t, g, unknown or other
  modified_base (446)..(446): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcacccaaataaagcccccaaactcatcatttatgatgccactaagcggccctctaggggtttctaatcgcttctcctggctccaagtctagcaacacggcctccctgacaatctctgggctccaggctgaggacgagctgattacactgctggctcatacngccnggtcgtatctnttatgtcttcggaacttgggaccttaaggtccaaccgttccgttaggttccaagccccaacggccccaacccactcgttctaaccc

SEQ ID NO: 417214 - DNA, 635 bp, Homo sapiens
  misc_feature: GZ8MTXP01CCX6V.19.78.H01.1.454.CMB.2.raw
  modified_base (305)..(305): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctagtaccaacatacaaccaaataaacgaccccaaactcatctatttangatcgaccaacgtaacgccggtaccctagtacggggtttactaacttcgtctttcgtcctcggctaccgtaagtccgtaacggaccaacgcccggtccctacccagacctaacttcgtccgtcgggtcctaccggacgggctagggacggtacggaggtctagtaattaccgtaattcggacttggacttctattacgtcgtacgtaggttcttaattccttattacgtgttaccgtaacggacgttacgggaaccttagggtacctaccggttaccgttagggttcccaacggccccaaccgtaccccaacccgttgtcgttcctcccg

SEQ ID NO: 417215 - DNA, 616 bp, Homo sapiens
  misc_feature: GZ8MTXP01AO6JY.19.78.H01.1.454.CMB.2.raw
  modified_base (224)..(224): a, c, t, g, unknown or other
  modified_base (280)..(280): a, c, t, g, unknown or other
  modified_base (289)..(289): a, c, t, g, unknown or other
  modified_base (299)..(299): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttagaaattctaaccttgtctctggtacaacatcaaccaaataaacnccccaaacncatcatttangatcgaccactaagcgccctcgtagggtttctaagtctacttctcctcggtctcctaagtctacgggacaacgaccgggtccctcccgtacgacctaatccgtcgtcgggccttccgaaggtccgtgaagggacggagggtctacgtacttactactgccggtcgtctagtataggtctaacggtcgtacgttacttcttcgttaacttcgttacggtaacgtacggttacggtaaaccgttacgtaccgtaccgttacgttcgttaccgaaccgacccaacccggtaccccacccttactcgttaaccgttccccg

SEQ ID NO: 417216 - DNA, 546 bp, Homo sapiens
  misc_feature: GZ8MTXP01AQPM0.19.78.H01.1.454.CMB.2.raw
  modified_base (265)..(265): a, c, t, g, unknown or other
  modified_base (374)..(374): a, c, t, g, unknown or other
  modified_base (410)..(410): a, c, t, g, unknown or other
  modified_base (423)..(423): a, c, t, g, unknown or other
  modified_base (453)..(453): a, c, t, g, unknown or other
tcagtactctcgtgcacgaccggtgctcgatttagtgtgagtagtttgggtttgggggggtcacaagaggcagcgctctcgggacgtctccaccatggcctgggctctgcctgctcctcactctcctcactcaggacacagggtcctgggcccagtctgccctgactcagtctgcctcgtgtctgggtctcctggacagtcggtcaccatctcctgcactggaaccagcagtgatgttagaaattctaactgtctctgtacacancaccaaataacgaccccaaactcatcattatgatgccaactaacgccggtccctacgtagggggttttactaaatcgtacttctcctggctaccaagtctaggacaacncgcctccctgacatctctcggctcgagctgagacgngctagatactacngctggctcgatatgcagtcgtatctcgttntcgtcgttcggaacgttcgggtaaccaacggtccgacccgttcgttcgaccgaacgacccaacggtccccacccgttactcgttccgtaaccc

SEQ ID NO: 417217 - DNA, 618 bp, Homo sapiens
  misc_feature: GZ8MTXP01DCLQV.19.78.H01.1.454.CMB.2.raw
  modified_base (195)..(195): a, c, t, g, unknown or other
  modified_base (447)..(447): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggccagtctgccctgactcagtctgcctccgtgtctggtctctggacngtcgtcacatctcctgcactggaaccagcagtgagttgttagaaattcctaaacttgtctcctggtaaccaacactacaaccaaataaacgaccccaaactcatactaatttatgatcgaccactaacgccggtcccttacgtacgggtttctaatcgtcttctcctcggctcgtaagtcgtcggactaacgaccggtccctaccctagacctaatctacgtcggctaccgaggctaggacggacgacggtntacgtattacgtacgtgtctggtctactaatagtgtccgtaggtacttaattcttcctttagtcgttacgttcggaaacgttcgggtaaaccttacgggtacctaaccggttacttacgggaccaaccgaacccaacggaccccaacccgttacgtcgttcccgtaacccg

SEQ ID NO: 417218 - DNA, 651 bp, Homo sapiens
  misc_feature: GZ8MTXP01EC70L.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgtagaaattctaactgtctctgtacacatacaaccaaataaacgaccccaaatcatactatttatgatcgaccaacgtaacgccggtcccgttacggtaggggtttacctaagttccgtctttctccgtcggctaccaagtccgtacggacctaaccgcccggtcccttacccagtacctaacttcgtccgtcgggtcctaccgagggtacgagggacgggtaacggtaacgggtctagtaactttaaccgtacgtcggtctacgggtccttataagtacgtcgtacgttcgggttaccttattccttacgtttagtcgttcgtaacgaacggttacgggtaaccttaggtaccgtcgttacgttcgttaccgaaccgacccaaccggtccccaacccgttatccgttccttaacccg

SEQ ID NO: 417219 - DNA, 582 bp, Homo sapiens
  misc_feature: GZ8MTXP01D9ST6.19.78.H01.1.454.CMB.2.raw
  modified_base (308)..(308): a, c, t, g, unknown or other
  modified_base (387)..(387): a, c, t, g, unknown or other
  modified_base (454)..(454): a, c, t, g, unknown or other
tcagtactctcgtgcacgaccggtgctcgatttagtgtgagtagtttgggtttgggggtcacaagaggcagcgctctcgggacgtctccaccatggcctggggtctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaaccaacatacaacccaaataaacgaccccaaaatcaatcatttangatcgaccaactaagccggaccctcgtaggggtttactaagtccgtcttctcgtcggctaccgaagtctggaccaaacncggccctaccctagaacaactctcgtacgggctccaggtcagaggacgaggctagattacactgctnactcatatgacaaggttctactcttcttatgttcttacggaaacgttcggaaccgtaaacggttcaaccggtccttagggttcaacgccccaaacggcccaaacccctcttacgtccaacgtttcccc

SEQ ID NO: 417220 - DNA, 673 bp, Homo sapiens
  misc_feature: GZ8MTXP01A7IM4.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaactgtctctgtacaacatacaaccaaactaaacaccccaaactcatactatttatgatcgaccagtaacgccgtccctcgtacgggtttactaatccgtctttcctccgtcggtactaccgtaagtcgtaacggacccaacgacccgggtccctacccgtagaacctaacttccgtcgtcgggtcctaccggtaggcgtagggaaggaaccggaggtcctagtaacttacgtacgtgtcctggggtacctttacaagttacgtacggtacgtacggtttacgttacttcttactttaacgttcggttccgttaacgggtaaacggttaccggggtaaacccttaaacggtaccctaacccggttaccgttcggaccgaacccgacccgtaaccggacccctaacccttacgtccgttcctaacccg

SEQ ID NO: 417221 - DNA, 629 bp, Homo sapiens
  misc_feature: GZ8MTXP01AH1ZL.19.78.H01.1.454.CMB.2.raw
  modified_base (221)..(221): a, c, t, g, unknown or other
  modified_base (258)..(258): a, c, t, g, unknown or other
  modified_base (356)..(356): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctctgcactggaaccngcagtgatgttagaattctacttgtctctgtaccaanatcaccaaataacgaccccaaactcatcatttatgatgaccactaacgcgccctgtacgggtttctaatcgcttctcctggctcaagtctaggcaacncgcctccctgacatctcgtgggctccgaggtcgtggaggaccgaggcctggtaacttactactgctcggtctacatagtgtccgtaggttcgtaacttcttacgttacgttcggttccgttaacggtaaaccggttcggggtaaaccccttaaacgggttccccgtaacccgggtttaccccgttacggggttacccaacccgggtaccccgtaaacccggggaaccccctaaacccccggttaccttaacggttaaccccgtttaacccccg

SEQ ID NO: 417222 - DNA, 770 bp, Homo sapiens
  misc_feature: GZ8MTXP01BGUJX.19.78.H01.1.454.CMB.2.raw
  modified_base (261)..(261): a, c, t, g, unknown or other
  modified_base (278)..(278): a, c, t, g, unknown or other
  modified_base (286)..(286): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctcctgcactggaaccagcagtgatgttagaattctaacttgtctctgtacaanatacaaccaaataaacnccccaaancatctattatgatcgaccaacgtaacgccggtacccctacgtacggggtttactaaactccgtcttacctccgtcggtcctaccgaacgtccgtaacggaccaaccgtacccggtacccttaccctacgtaactaacttccgttcgtcgggtaccttacccggaacgggtcgttacgggaacggggtaaccggtacgggtaccgttaacggtaacctttaaccggtaaccttacgggttaccttcggggtaccccttataaacgttcgtaccggtaccgttaacggggttaccgtttaacgtttacctttccgttttacgtttaccgggtttaccggtttaacccgggtaaaccgggttaaccggggtaacccgttaaacgggttaccccgtaacccgttaccggttaccgggttacccgaaacccggaccccgtaaaccgggaccccctaaaccccttacgttccgttaacccgttaaccccg

SEQ ID NO: 417223 - DNA, 602 bp, Homo sapiens
  misc_feature: GZ8MTXP01C66TJ.19.78.H01.1.454.CMB.2.raw
  modified_base (377)..(377): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtaccaacatacaccaaataaacgaccccaaactcatctatttatgatcgaccaactaaacggccggcccttcgtacgggggtttctaacttcgcttctcctggctcaagtctggcaacncggccctcctgacaatctcgtgggctaccgaggctggaacggacgaggtctagtacttactactgctcggcttactatacgtgtcgtacggttcgttaattccttctttacgttcgttcgttaacggtaacgttcggggaaccgttaaacggtccgtaccggttccgttacgggttccaacggacccaacgggaccccaacccgttacgttcgttccgtaacccg

SEQ ID NO: 417224 - DNA, 551 bp, Homo sapiens
  misc_feature: GZ8MTXP01D1D02.19.78.H01.1.454.CMB.2.raw
  modified_base (261)..(261): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctacttgtctctggtacanatcaccaaataaacgccccaaactcatcatttatgatgccaactaagcggccctcagggggtttctaatcgtcttctctggctcaagtctggctaacacggcctccctgacaactctctgggctcaggctgaggacgaggctgacttactactgtcctgggctcaatagtcgcgtagggttctaacttcttcttattcggttcttcgggaacttgggggaccttaaagggtccctaaccgttccgttaggttccaacgcccaacggtcccaacccacttcgttaactccg

SEQ ID NO: 417225 - DNA, 534 bp, Homo sapiens
  misc_feature: GZ8MTXP01BNCTD.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttgaaattctaacttgtctctgtacaacatcaccaaataaacgccccaaactcatcatttatgatgccaactaaagcggtccctcgacggggtttctaatcgcttctcctggctcaagtctggccaacgacggccctccctgacctaatctactcgggctccgagctaggagggacgaggtactgattactactgctggctgatatgcgtaggtctattctcttatgtctcggaacttgggaacagtccacgttcgttcggttcaacgtcccaacggcccaacccgctcgcttaacccg

SEQ ID NO: 417226 - DNA, 591 bp, Homo sapiens
  misc_feature: GZ8MTXP01BSFUM.19.78.H01.1.454.CMB.2.raw
  modified_base (224)..(224): a, c, t, g, unknown or other
  modified_base (464)..(464): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttgaaattctaactgtctctgtacacatcaccaaataaacgccccaaactcatcatttatgatcgccaactaacgccggtccctcgtacgggggtttctaatcgcttctcctggctccgaagtctaggcaacacggcctctctacgacaactctctgggctcgaggctggaggacgagctgattactacgtgctgcttacattagtcgcgtaggttccgttaattccgttntttaacgttgttaacgttacgggttaacgttacggggaaccgtaacgggttccgacccggttccgttacgggttcccaccggtaaccccgaaacgggccccttaaaacccctcgttcggttaacccc

SEQ ID NO: 417227 - DNA, 563 bp, Homo sapiens
  misc_feature: GZ8MTXP01CMDGE.19.78.H01.1.454.CMB.2.raw
  modified_base (546)..(546): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctggtaccaacatcacccaaataaacgaccccaaactcatcatttatgatgccactaacgcggccctcgaggggtttctaatcgtcttctcctggctcaagtctcggacaacacggcctccctgacaactctcgtggctccgaggctgagacgagctgattactactgactggctcatatgactacggtcgttatcttcttagttcgttcgttaacggtaacttcggggtaaccttaacggtccacccgttccgttaggttccaacgacccgaacggccccaaaccccnctaacgttccgtaaccc

SEQ ID NO: 417228 - DNA, 520 bp, Homo sapiens
  misc_feature: GZ8MTXP01BHPHA.19.78.H01.1.454.CMB.2.raw
  modified_base (263)..(263): a, c, t, g, unknown or other
  modified_base (440)..(440): a, c, t, g, unknown or other
  modified_base (452)..(452): a, c, t, g, unknown or other
  modified_base (509)..(509): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaanatcacccaaataaagcccccaaactcatcatttatgatgccaactaagcggccctcgtagggggtttctaatcgcttctcctggctccaagtctagggccaacgacggccctccctgacaatctacgtggctccaggctgagacgaggctagattactctagctggcttcatatgcnggtctatcgttnttatgttctcgggaacttggggaccaaggtcacgttcagttcaagccaagccacccntcgttctaacc

SEQ ID NO: 417229 - DNA, 643 bp, Homo sapiens
  misc_feature: GZ8MTXP01BTE72.19.78.H01.1.454.CMB.2.raw
  modified_base (262)..(262): a, c, t, g, unknown or other
  modified_base (296)..(296): a, c, t, g, unknown or other
  modified_base (433)..(433): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctagtacaanatacaaccaaataaacaccccaaatcatcattangatcgacaactaacgccgtacctgtagggtttactaatcgcttcgacctcggactaccaaagtccgtaacggaccaacgccgtaccctcccgtagaactaactcttcgcggcctaccgaggcctaggacggaacggngtactagtacttactcgtcgtactacggtctagtaagtacgtcggtacgttacggttacgtttaacgttcttacgtttacgttcgttaccggttaacggaacggttacgggtaaaccgttaacggttacccgtaaccgttacggttaacggttacccgaaccggtacccgaacccgaacccctaacccgttacgttccgttccgtaaccg

SEQ ID NO: 417230 - DNA, 577 bp, Homo sapiens
  misc_feature: GZ8MTXP01B4GLL.19.78.H01.1.454.CMB.2.raw
  modified_base (320)..(320): a, c, t, g, unknown or other
  modified_base (430)..(430): a, c, t, g, unknown or other
  modified_base (457)..(457): a, c, t, g, unknown or other
  modified_base (531)..(531): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcggtcaccatctcctgcactggaaccagcagtgatgttagaaattctaacttgtctctggtaccaacatcacccaaataaacgaccccaaactcatcatttatgatgacactaagcgccctnaggggtttctaatcgcttctctggctccaagtctcgacaacaccggccctccctagacaatctactgggctcgagctgacggagaggctagattacaactgctgggctanactaattgactaggtcttaacgttctntttacttcgttcgttaacgggaaacgttggggtaacccttaaagggtcccgtaccgttacccgttaggttaccnccggacccaaccggtaccccaaccccgcttaacgttccttaacccg

SEQ ID NO: 417231 - DNA, 728 bp, Homo sapiens
  misc_feature: GZ8MTXP01D5HKW.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatacaaccaaataaacgaccccaaactcaatacattatgatcgaccaactaaagccggtcccttacgtaaggggtttactaagtcgtacttctctcggtctacctaaagtcgtaacgggaccaaccgaaccgggtccctaccccgtacgaacctaaactccgttacgtacggggtccttacccggaggaccgtacggaaagggaaccggaagggtaccttagggaaactttaccgttaaaccttgtacctttcggggacccttacgtaaattacgttaggacccgtaagggtttaccgttaattcgtttacctttaagttcggttacgtttaaccgggaaacgttacggggaaacccgttaaacgggtacctaacccggttaccgttacggggttaccaaccggaacccccgtaaccgggaaccccaaacccccgttacgttaacgttccccttaaccccg

SEQ ID NO: 417232 - DNA, 587 bp, Homo sapiens
  misc_feature: GZ8MTXP01ES30K.19.78.H01.1.454.CMB.2.raw
  modified_base (265)..(265): a, c, t, g, unknown or other
  modified_base (303)..(303): a, c, t, g, unknown or other
  modified_base (306)..(306): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacanatacaccaaataaacgaccccaaactcatctatttatnatnccaactaacgcgcccctcgtaggggtttctaatcgtcttactctggctacaagtctacggcaacacggccctccctagacctaatctcgtcggctcgaggctgagacgagtctgattactactgctaggcttacatactgcgtacggttcgttaacttcttctttagttcggttccgttaacgggtaacgttacgggaccgttaacggtccgtaaccgttccgttacggttccgaaccgacccgaacggaccccaacccgttctaacgttcccttaacccg

SEQ ID NO: 417233 - DNA, 561 bp, Homo sapiens
  misc_feature: GZ8MTXP01CQ7AK.19.78.H01.1.454.CMB.2.raw
  modified_base (303)..(303): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatacacccaaataaacgacccccaaactcatcatttangatgccataacgcgccctgagggtttctaatcgtcttctcctggctcaagtctaggcaacgcggccctccctagacaactctcgtcgggctcccgaggcctaggacggacgaggctagacttacgtactgcttggcttcatagtcgcgtagggttctatcttacttagttgtcgttcggaacgttcgggaaccaggtaccaccggttccgttaggttccaacggaccccaaggtccccaacccactcgttctaacccg

SEQ ID NO: 417234 - DNA, 645 bp, Homo sapiens
  misc_feature: GZ8MTXP01EJCN3.19.78.H01.1.454.CMB.2.raw
  modified_base (260)..(260): a, c, t, g, unknown or other
  modified_base (262)..(262): a, c, t, g, unknown or other
  modified_base (284)..(284): a, c, t, g, unknown or other
  modified_base (288)..(288): a, c, t, g, unknown or other
  modified_base (293)..(294): a, c, t, g, unknown or other
  modified_base (296)..(296): a, c, t, g, unknown or other
  modified_base (312)..(312): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctcctgcactggaaccagcagtgatgttagaattctaactgtctctgtacaanancaccaaataaacgaccccaaancatnattannangacactacgcgccctntagggtttctaatcgcttctcctggctcctaagtctacggacaaccgacggccctacccgtgaacctaatccgttcgtcgggccttccgaagggcgttaggagggaacggaggtaccttaggtaactttaacctacgtcgtaccgttcggccttacgaattaacgtcggaccgtaagggttccgttaaacttcctttactttacgtttccggttacgtttaaccgggtaaacgttacggggtaacccgttaacggtccaacccggttccgttaacggttccgaacggaccccgaacggaacccccaaccccgttccttcgttcccgtaacccg

SEQ ID NO: 417235 - DNA, 602 bp, Homo sapiens
  misc_feature: GZ8MTXP01AHJ6T.19.78.H01.1.454.CMB.2.raw
  modified_base (422)..(422): a, c, t, g, unknown or other
  modified_base (442)..(442): a, c, t, g, unknown or other
  modified_base (594)..(594): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatcaaccaaactaaacgccccaaactcatcatttatgatcgaccaactaacgccggtccctagtacgggtttctaatcgtcttctctcggctccaagtctggaccaaccgaccggcctaccctgacaactcctcgtgggcctccgaggcctggaacggacgacgggctgtaacttactactgcttgcctntatagtgactagggttactnttcttcttatcgttctacggggaactcgggaccacggtcctaccgtctaggtcaccgtacccgaaacgccccaacccgtaactcgttacctacgttccgttccttccccacccgttcttacccgaaggtacaagttacgcggacggtccggngtaacggg

SEQ ID NO: 417236 - DNA, 724 bp, Homo sapiens
  misc_feature: GZ8MTXP01B625U.19.78.H01.1.454.CMB.2.raw
  modified_base (300)..(300): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcactggaaccagcagtgatgttagaaattctaacttgtctctgtacaacatacaaccaaataaacgccccaaactcatcatttangatcgaccactaagccgtccctacgtacgggtttactaactcgtcttcgtcctcggtctaccgaacgtccgtacggaccaaccgaccgggtcccttacccctcggaacctaaacttccgtaccgtacggggtccttacccgaacgggtccgttacgggaagggaacccggaagggtccttaggtaactttaacgtaaccgtgtccgttaggggctttacgtaacgttaacgttcgaccggttaacggggttactttacgttaacctttcgtttaaacgtttccgttacccggtttaacgggtaaccgttacgggggtaaacccttaacgggtacccgtaaccgttacccgttcgggttaccgaaccggaccccgtaaaccgggaccccctaaccccgttacgttaaccggttccgttaaccccg

SEQ ID NO: 417237 - DNA, 563 bp, Homo sapiens
  misc_feature: GZ8MTXP01BFC9E.19.78.H01.1.454.CMB.2.raw
  modified_base (395)..(395): a, c, t, g, unknown or other
  modified_base (467)..(467): a, c, t, g, unknown or other
  modified_base (493)..(493): a, c, t, g, unknown or other
  modified_base (540)..(540): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccgtgtgatgttggacttatacccttgtctcctggtaccaacaacaccccggacaaacgcccccaaactcctgatttatgagctcataacgcgccctgacgggggtttctggagcgtcctttctcgtcggccctccgagggtcctagaacaaaaccgaccgggccctacgngacgatctcgtcgggcctccgaggcctgggagggaccgagggctaggaacttattattgcgtgcgcatacgngaaggaacgtgacagtagtgggtggnggcgggcggaacggacgaggtcgccgtcgtggcgcgaccgtaagccnccgccccgtgcctcgttcgtccg

SEQ ID NO: 417238 - DNA, 597 bp, Homo sapiens
  misc_feature: GZ8MTXP01EVZG9.19.78.H01.1.454.CMB.2.raw
  modified_base (296)..(297): a, c, t, g, unknown or other
  modified_base (300)..(300): a, c, t, g, unknown or other
  modified_base (328)..(328): a, c, t, g, unknown or other
  modified_base (334)..(334): a, c, t, g, unknown or other
  modified_base (368)..(368): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctctgcactggaaccagcagtgatgttagaaattctaacttgtctctgtacacatacaaccaaataacaccccaaatcatcattannatnccaacagcgccctgtagggtttacatcnctctcnggtctacagtctagaccaacgccgccctccctanaaccacttcgtcgtcgggcctccgaggcgtaggacggacgaggtctaggtaacttactacgtgcgtacgcttacgaattagtcgtacgtcgggttacttaacttcttactttagttcgttccgttaacggtaacgttagggtaaacccgaggttacccgtaccgttaccgttaggcccaaccggacccgtaaccggtaacccccacccgacttcgttcccgttaacccg

SEQ ID NO: 417239 - DNA, 647 bp, Homo sapiens
  misc_feature: GZ8MTXP01EX8SZ.19.78.H01.1.454.CMB.2.raw
  modified_base (273)..(273): a, c, t, g, unknown or other
  modified_base (295)..(295): a, c, t, g, unknown or other
  modified_base (342)..(342): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgcaccatctcctgcactggaaccagcagtgatgtagaaattctaactgtctctgtacaacatacaaccaaanaaacacccaaatcatacattangatcaccaactacgcgccctgtacgggttactaactcgtctctccgnggactacgtaagtctacgaccaaccaccggtaccctccctacgaaacctaacgttcctcggtcggggtacctacccgtagggtaccgtaggaacggaacggacgggtctacggtaattactaactcggcttaggaccttagtaattagtcgtacgtacggttacgttaactttcttactttagtcgttacggtaacggtaaacggttacgggtaaaccttaacggtaccgtacccgttccgttaacggcccgaacgaccccgtaaacggacccctaaaccccgttagttcccgttcgtaaccccg

SEQ ID NO: 417240 - DNA, 766 bp, Homo sapiens
  misc_feature: GZ8MTXP01EVDH7.19.78.H01.1.454.CMB.2.raw
  modified_base (195)..(195): a, c, t, g, unknown or other
  modified_base (256)..(256): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcactggaaccagcagtgatgtagaattctaactgactctgacantacaccaaataacacccaatcatctattatgatcgaccaactaacggtccgcccctagtacgggggtttactaacgtcgtctttctccgtcggtacctaccgtaacgtccgtaacgggacctaaaccgtacccgggtccccttaccccgtacggtaaacctaacgttccgttaccggtcggggtaccttacccggaacgggtccgttaacgggaacgggtaaccgggtaaggttccgtaggtaacctttacctaacgtcggtccttcggggtacttaccgtaagttaacgtaccggtcgttaaccgggtttagttaaccgtttcctttaccgttttaaagttccggtttaaccggttaaccgggttaaaccggttacggggtaaacccgttaaccgggttaccccgtaacccggtttacccggttacgggttaaccccgaacccgggtacccccgtaaaacccgggtacccccaaaacccccgttcttaaccggttcccgtttaaccccg

SEQ ID NO: 417241 - DNA, 529 bp, Homo sapiens
  misc_feature: GZ8MTXP01CJTGA.19.78.H01.1.454.CMB.2.raw
  modified_base (397)..(397): a, c, t, g, unknown or other
  modified_base (418)..(418): a, c, t, g, unknown or other
  modified_base (431)..(431): a, c, t, g, unknown or other
  modified_base (434)..(434): a, c, t, g, unknown or other
  modified_base (440)..(440): a, c, t, g, unknown or other
  modified_base (455)..(455): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaactgtctctggtacaacatcaaccaaataaacgaccccaaaactcatcaatttatagatgaccactaaagcggccctacgtaggggtttactaaatcgctttctcctaggctccaaagtctaggcaacacggcctaccctgacaatctngggctcagctgagacgagctnattacactgctgntanatatgngtagtacgtactctntatcgtcgtaacgtacgttacgtaacgacgtacgtcgttcgttcgacaacaccaaccgaccaccactcgttctc

SEQ ID NO: 417242 - DNA, 713 bp, Homo sapiens
  misc_feature: GZ8MTXP01BBTH1.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtcctcgtgactaggtcgtacacctatcctctgacacgtacggaaccagctagtgtagttggttaagtaaacttaccttacttgtcctcgtacgtaaccaacactaccaaacctaaaactaacccgaaccccctaaactactaacttactttaaatttagtagtaactccgaaccctaacgtaaccggtcccggtaccccgttagggtttacgggtttactaacgttccgtcttcgtccgtcggtctacgtaacgtcgtaacgacaaccgccgtccctaccgacgactactcgtcgtcgcctacggaggtcgtaggacggaacggtagtcgtacgtacttaacctcgtcgtcgttcggtacttagtaacgttgtacgtacggtaggtttaccttattcttagtttacgttccgttacggtaacggtaacggttacgggtaaaccgttccggtaccgtacccgttcgttacgttaccgaacccgtacccgaacgtaccccaccgttacgttcgttaaccgttaacccg

SEQ ID NO: 417243 - DNA, 569 bp, Homo sapiens
  misc_feature: GZ8MTXP01BZPGI.19.78.H01.1.454.CMB.2.raw
  modified_base (267)..(267): a, c, t, g, unknown or other
  modified_base (277)..(277): a, c, t, g, unknown or other
  modified_base (299)..(300): a, c, t, g, unknown or other
  modified_base (393)..(393): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtccggtcaccatcctcctgcactggaaccagcagtgatgttagaaattctaactgtctctgtacaanatcaccaaanaacgccccaaactcatcattannatcaccactagcgccctgtagggttactaagtctcttctccgtcggctacaagtctaacggacaacgcgccctcctgactatctcgtcggtcncgagctggaggacgaggtctgattactctagtctcggctgtactagtgtcgtaggttctattcgttcttagtcgtacgttaacggtaaacgttccgggtaacttacggtccgacccgttcgttacggttccaacggtacccaacggaccccaaccgttctaacgttccgtaacccg

SEQ ID NO: 417244 - DNA, 545 bp, Homo sapiens
  misc_feature: GZ8MTXP01CV7NB.19.78.H01.1.454.CMB.2.raw
  modified_base (300)..(300): a, c, t, g, unknown or other
  modified_base (377)..(377): a, c, t, g, unknown or other
  modified_base (431)..(431): a, c, t, g, unknown or other
  modified_base (454)..(454): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctacttgtctctgtacacatacacccaaataaacgcccccaaactcatcatttatgatnccactaacgcggcccttcgagggtttctaatcgcttctcctggctcaagtctacggcaacacgcctcctgacatctntcgggctcaggtctaggagacgaggctagattacgtactgctggctactattancgcgtaggtcttatctcttactnttcgtttcggaacgttcgggaacttacggtacctccggttaccttaggttccaacgacccaacgggacccaaccccatcgttaaccctccc

SEQ ID NO: 417245 - DNA, 569 bp, Homo sapiens
  misc_feature: GZ8MTXP01ATKM0.19.78.H01.1.454.CMB.2.raw
  modified_base (270)..(270): a, c, t, g, unknown or other
  modified_base (347)..(347): a, c, t, g, unknown or other
  modified_base (486)..(486): a, c, t, g, unknown or other
  modified_base (516)..(516): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtttcctggtaccaacatcaacccaaataaacgcccccaaatcatcatttangatgccactaagcgcctcgagggtttctaatcgctttctctggctccaagtctggcaacacgcctcctgacatctcnggctcgaggctagaggcgagctgattactactgctgctcatagtgcgtaggtctatcttcttatcgtcttacgggacgtcggggaacctaaggtccacccgtccgtaggtcaacgcccgaaaccggacccaaacccctntcgtccttaccttccgttcccggttccccncccgttcccttccacggtaagacgtaaccgtggacggcgggtcttgggaaccg

SEQ ID NO: 417246 - DNA, 598 bp, Homo sapiens
  misc_feature: GZ8MTXP01A4YPS.19.78.H01.1.454.CMB.2.raw
  modified_base (301)..(301): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacacccaaataaacgaccccaaactcatcatttatnatgccaactaagcggtccctcgtaggggtttctaatcgtcttctccgtggctacgaagtataacgacgaaacggccctacctagacaatcgtactgggctcgaggctgaggacgaggctagacttactactgctgctacatatgcgtaggttccttattctctttactcgtttacgttcggaacgttacgggacctaacgggttcctacccggttccgttacgggttccgaaccgtaaccccgaaaccgggtaacccctaaaccccgtacccgttacgtcccgttaacgtttccccg

SEQ ID NO: 417247 - DNA, 534 bp, Homo sapiens
  misc_feature: GZ8MTXP01BBUKM.19.78.H01.1.454.CMB.2.raw
  modified_base (224)..(224): a, c, t, g, unknown or other
  modified_base (261)..(261): a, c, t, g, unknown or other
  modified_base (277)..(277): a, c, t, g, unknown or other
  modified_base (295)..(295): a, c, t, g, unknown or other
  modified_base (429)..(429): a, c, t, g, unknown or other
  modified_base (432)..(432): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttagaaattctaacttgtctctgtacanatacaccaaataaacnccccaaatcatcatttangatgccaactaacgcggaccctcgtagggtttctaatcgtcttctcctggctaccaagtctacggacaacgcgtccctccagacactctctgggctccgaggctggaggacgagctgattactctgctggctantangacgaggtctatctcttactgttcgtaacggtaagttcgggaccttaggtcctaccgttcgttagttccaacgcccgaacgcccaacccatcgcttaacccg

SEQ ID NO: 417248 - DNA, 798 bp, Homo sapiens
  misc_feature: GZ8MTXP01AP1YQ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctctggacagtcgtcaccatctcctgcactggaaccagcagtgatgttagaattctaacttgtctctgtacaacatacaaccaaataaacgaccccaaactcatactatttatagtatcgaccaactaacggccggtccctacggtaacggggtttactaacgttcgtcttcgtccgtcggctaccgtaacgtcgtaacggaccgaaccgtacccgggtccctacccgtacgtaacctaacgttccgtaccggtacggggtacctacccggagggtccgttacgggaaacgggtaccgggtaacgggtaccgttaacggttaaacgtttaaccgttaaacgttcggtcccgttacggggtaccttaacccgtaagtttaacggttaccggtaaccgttaacggggttaccgttttaaccgttttacctttaccgttttaaacgtttccggttttaaccgggtttaacccggggttaaacgggttacggggtaaaccccggttaaacggttaccccgtaaccccggttaccggttaacgggttacccgaacccggtaccccgaaacccgggttaacccccaaccccgttaccgttccgttaacccgttaaccccg

SEQ ID NO: 417249 - DNA, 687 bp, Homo sapiens
  misc_feature: GZ8MTXP01ASHM4.19.78.H01.1.454.CMB.2.raw
  modified_base (227)..(227): a, c, t, g, unknown or other
  modified_base (302)..(302): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatcctcctgcacgtggaaccngcagtgattgttagaaattctaactgtctctagtacacactacaaccaaataacgaccccaaatcatactattanagactacgacctaacgtaacgccggtcccttacgtacgggtttactaactcgtcttactccgtcggtcctacgtaacgtcgtaacgggaccaaccgaccggtccctacccgtacgaacctaactcgtcgtacgggctaccggagtcgtagacggacgacgtcgtagtaacttacactcgtcgtacgtactacgtaagttacgtcgaccgtaggttaccttaactttccgttactttacgtcgttaaccggtttaacccgggaacgttaccggggaaacccgttaacgggttccgtaaccccggttaccgttacgggttacccgaacccggtaaccccgtaaccgggacccccaaacccggttcctccggttaaccttaaccccgg

SEQ ID NO: 417250 - DNA, 592 bp, Homo sapiens
  misc_feature: GZ8MTXP01DED2P.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacacatcaaccaaataacgaccccaaatcatcatttatgatcgaccaactaacgcggcccttacgtacggggtttactaatcgctttctcctggctaccaagtcgtagccaacgcggccctccctagacctaatctctgggctccgaggctgaggacgaggctagattacgtactgcttggactctaatacgtcgtacgtcgtttacgttaacttccgttctttacgttcggttcgtttaaccggtaacggttacgggtaccttaaacgggtcctaaccgttcgttacgttaccaacgacccaacggccccaacccgacttcgttaactcccg

SEQ ID NO: 417251 - DNA, 548 bp, Homo sapiens
  misc_feature: GZ8MTXP01EAU5R.19.78.H01.1.454.CMB.2.raw
  modified_base (232)..(232): a, c, t, g, unknown or other
  modified_base (266)..(266): a, c, t, g, unknown or other
  modified_base (283)..(283): a, c, t, g, unknown or other
  modified_base (341)..(341): a, c, t, g, unknown or other
  modified_base (355)..(355): a, c, t, g, unknown or other
  modified_base (358)..(358): a, c, t, g, unknown or other
  modified_base (383)..(383): a, c, t, g, unknown or other
  modified_base (386)..(386): a, c, t, g, unknown or other
  modified_base (506)..(506): a, c, t, g, unknown or other
  modified_base (534)..(534): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaanatcaacccaaataaacgccccaaatcatcattangatgcataagcgccctnagggtttctaatcgcttctctggctcaagtctggcaacacggcctccctgacactccnctggctcaggctgnggngaggctgattactactgctgcctanatngcgtagtctatcttcttgtgttcgttacggggtaacgtcggaaccgtacggtcctaccgtcgtaggtacacgtacccgaacgacccaacccaactcgttcctaccttccgtccgtccccncccgttccttaccaacgtagaacgtcgnggacggtcggcgtg

SEQ ID NO: 417252 - DNA, 577 bp, Homo sapiens
  misc_feature: GZ8MTXP01BETQ5.19.78.H01.1.454.CMB.2.raw
  modified_base (386)..(386): a, c, t, g, unknown or other
  modified_base (397)..(397): a, c, t, g, unknown or other
  modified_base (402)..(402): a, c, t, g, unknown or other
  modified_base (404)..(404): a, c, t, g, unknown or other
  modified_base (412)..(412): a, c, t, g, unknown or other
  modified_base (415)..(415): a, c, t, g, unknown or other
  modified_base (427)..(427): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaaccagcagtgatgttagaaattctaaacttgtctctgtacaacatacaacccaaataaacaccccaaactcaatacattatgatgcactaagcggccctacaggggtttactaaatcgcttctccttggctccaaagtcaggacaacacggccctccctanacatctctgcncgagngngagagagntanactactactgcngctcatacgtgcgtacgtacgttacttcttacttacttacgttcgttaacggtaacggttacgggtaaccggttaaacggtaccgtaaccgttaccgttacgttacgaaccgacccgaaccgaccctaaccccacctaacgttcgtaacc

SEQ ID NO: 417253 - DNA, 534 bp, Homo sapiens
  misc_feature: GZ8MTXP01EGONS.19.78.H01.1.454.CMB.2.raw
  modified_base (422)..(422): a, c, t, g, unknown or other
  modified_base (465)..(465): a, c, t, g, unknown or other
  modified_base (522)..(522): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcaaccaaataaacgcccccaaactcatcatttatgatgaccaactaacgccggccctcgtaggggtttactaactcgcttctcctcggctcaagtctacggacaacgacggccctccctagacaactctactcgggctccgaggctggaggacgnggtctagattactactgctggctcatagtgctaggtctatctnttatgtcttggaacttggaccaggtccacgttcgttgcaacgccaacgcccaacccntcgttcctaacg

SEQ ID NO: 417254 - DNA, 579 bp, Homo sapiens
  misc_feature: GZ8MTXP01A7ZVG.19.78.H01.1.454.CMB.2.raw
  modified_base (259)..(259): a, c, t, g, unknown or other
  modified_base (273)..(273): a, c, t, g, unknown or other
  modified_base (292)..(293): a, c, t, g, unknown or other
  modified_base (354)..(354): a, c, t, g, unknown or other
  modified_base (367)..(367): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggcaccatctcctgcactggaaccagcagtgatgttgaaattctaactgctctgtacaanatcaccaaataacnccccaaactcatcatttannatgccactaacgcgccctcaggggtttctaatcgcttctcctggctccaagtcaggcaacncggccctccctanacactctcgtcgctcgaggtcgtaggacggacggacgtacgtacgtacttactacgtcgtcgtcgtctactatacgtcgtcgtacgttacgttacttcttacgttacgttcgttcgttaacggtaacgttacggtaaccgaacgtaccgtaccgttaccgttacgttaccgaaccgacccgaacccgacccacccttacctccgttccgtcc

SEQ ID NO: 417255 - DNA, 771 bp, Homo sapiens
  misc_feature: GZ8MTXP01BWLSG.19.78.H01.1.454.CMB.2.raw
  modified_base (195)..(195): a, c, t, g, unknown or other
  modified_base (259)..(259): a, c, t, g, unknown or other
  modified_base (275)..(275): a, c, t, g, unknown or other
  modified_base (294)..(294): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcactggaaccagcagtgatgttagaattctaactgtctctgtaccanatcaaccaaataaacnccccaaatcatcaatttangatcgaccaactaacgccggaccctacgtagggggttttactaaacgttccgtactttccgttaccgtcggtaccttacccgtaaagtccgttaacgggaccctaacccgaacccgggtccccttccccgtagtaacctaaacttccgttaccggtaccggggtccttaccccgagggtaccgttacgggaaacgggaaccgggtacgggttaccttaagggtaacctttaaccgtaacgttacggtaccttcggggtacttacctaagttacttacggaccgtaacgggtttcgttaaacttcctttacgtttaacgttcggtttacccgttaacgggtaaccgtttacggggaaacccttaaacgggttacccgtaacccgggttacccgttaagggttaccccaaccgggtacccccgaaaaccgggttacccccaaacccccgttaacgttcccggttaacccttaacccccg

SEQ ID NO: 417256 - DNA, 623 bp, Homo sapiens
  misc_feature: GZ8MTXP01DJ1CC.19.78.H01.1.454.CMB.2.raw
  modified_base (225)..(225): a, c, t, g, unknown or other
  modified_base (264)..(264): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgtagaaattctaacttgtctctggtaccaanatacaacccaaataaacgaccccaaactcatctatttatgatgaccaactaacgcgtccctacgtacggggtttctaatcgtcttactcctcggctcaagtctacggacaacacggccctaccgtgacaactctcgtcgggtctccgaggtcgtacggaggtacgaggtctagtattactacgtgtcctagggtcctagtatactcgacgtaggttcgttattcctttcttaacgtcgttacgtttaacggaaaccggttcgggtaaaccaacggttacctaccggttaccgttaccggttaccaaccggaccctaaacgggcccctaaaccccgttacgtccgttaaccgttaacccg

SEQ ID NO: 417257 - DNA, 592 bp, Homo sapiens
  misc_feature: GZ8MTXP01BZR0S.19.78.H01.1.454.CMB.2.raw
  modified_base (281)..(281): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaacccaaataaacnccccaaaatcatcatttatgatgaccaactaagcggccctcgtaggggtttctaaatcgcttctcctggctaccaaagtctaggacaacgacgcctccctgaacaatctctgggctaccgaggctgaggacgaggctgattacactgctggcttcatagtgcaggtcctatctcttagtcgttcgttaacgaacgttggggaacccaaagggttcccaaacccggtttcccgttaaaggggttcccaaacggccccccgtaaaagggccccccaaaaccccccgttaagttccgttaacccgttaaccccg

SEQ ID NO: 417258 - DNA, 691 bp, Homo sapiens
  misc_feature: GZ8MTXP01CKZ6X.19.78.H01.1.454.CMB.2.raw
  modified_base (230)..(230): a, c, t, g, unknown or other
  modified_base (263)..(263): a, c, t, g, unknown or other
  modified_base (280)..(280): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtnatgtagaaattctaacttgtctctgtaccaacntacaacccaaataaacnccccaaatcatctaattatagatcgaccaactaacgccgtaccctcgtaggggtttactaaactccgtcttccgttccgtcggtactacccgtaaagtccgtacgggaccaaccgaaccgggtccctcccgttaacggaacctaaacggttcctccgtacggggtcccttaccgagggtaccttagggaacggacgtacgggtcctaaggttacttaactaccgtgtcctagggcccttaatataacgtgacgtacggtttacttaattcccttagtttacgttcggttaccgtttaacgggtaaaccttcgggggtaaacccttaacgggtaccccgtacgttaccgttaccgacgtaacgaaccccgaacggacccccaaacccgttcgtccgttcccgtttaaccccg

SEQ ID NO: 417259 - DNA, 572 bp, Homo sapiens
  misc_feature: GZ8MTXP01BYMQJ.19.78.H01.1.454.CMB.2.raw
  modified_base (264)..(264): a, c, t, g, unknown or other
  modified_base (299)..(299): a, c, t, g, unknown or other
  modified_base (400)..(400): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaanatcaacccaaataaacgccccaaatcatcatttangatgaccataagccgccctcgtagggtttctaatcgtcttctcctggctcaagtcgtagacaacgaccggccctccctagactaatctcgtgggcctacgnggcgtaggaggacgtaggctagtacttacactgctggctcatagtgcgtaggtcttattcttcttagttcgtcgttaacggaacgttcgggtaaccttaggtccgtaccgttacgttcggttaccaacgccccgaacggtaccccaacccttacgttccgttccttaacccg

SEQ ID NO: 417260 - DNA, 806 bp, Homo sapiens
  misc_feature: GZ8MTXP01DG91D.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcacgtggaaccagctagtgtattggttagaaacttcctaaacttgtctctggtaacaacatacaaccaaactaaacgaccccaaactcatactatttatgatacgaccaacgtaacgccggtccctttacgtaacgggggtttacttaacgttccgtcctttcgtcccgtcggtactccgtaaagtcgtaacggacccaaccgtacccgggtaccccttcccgtacggtaacctaattcccgttcgtccggggtccttaccggacgggtaccgttagggaacgggtaaccgggtacggttaccgttacgttaaaccgtttaacccgtacgttcgggtacccttacggggttacccgttaacttaacgtttaacggtaccggtaaccggttaacggggtttacgtttaacctttacgtttaccgttttacgttcgggtttaccggtttaaccgggtaaaccgggttacggggtaaaccgttaaccgggttacccgtaacccggtttaccggttacgggttacccgtaaccggaaccccggtaacccggtaacccctaaccccgttaccgttaacgttaacccttaaccccgg

SEQ ID NO: 417261 - DNA, 765 bp, Homo sapiens
  misc_feature: GZ8MTXP01CAEKG.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctcgccctgactcagtctcgcctccgtgtcgtgggtctccgtggacagtcggtcaccatctcctgcactacggaaccagcagtgattgttagaattcctaacttgtctcgtggtaccaacactacaacccaaataaacgacccctaaactcattactatttatgatcgacctaacgtacggccgtcccgttacgtacggggtttacctaagttcgtcttccgttccgtcggtactacccgtaagttcctaacggaccaaccgaccggtaccctacccgtagtacctaacgttcgtcggtcggccgtaccggacggcgtacgggaacgggtacgtacgggtcttacggttaaacttaccgttaacgtcgtaccgttacggggtacttacgtacgttaagtacggtacggttacggtttaacgtttaccttcgtttaccgttttaacgttcggtttacccggtttaacgggggtaaaccggttacccggggtaaacccgttaaccgggttacccgtaccccgggtttaccgttaccgggttacccgtaacccggtaccccggaacgtaaccccccgtaaccgttaccgttccggttaacccttttccccgg

SEQ ID NO: 417262 - DNA, 527 bp, Homo sapiens
  misc_feature: GZ8MTXP01AHKT0.19.78.H01.1.454.CMB.2.raw
  modified_base (196)..(196): a, c, t, g, unknown or other
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcgtcaccatctcctgcactggaaccagcagtgatgttgaaattctaacttgtctctggtaccaacatcacccaaataaacgcccccaaactcatcatttatgatgccactaagcggccctcgagggggtttctaatcgcttctcctggctccaagtctaggcaacacggccctcctgacaatctctgggctcaggctgaggaccgaggtcctagacttactaacgtgctgggcttnatatcgctagtcgtatcttcttatgtcttcgacttggaccttaaggtcaccgttcgttaggttcaacgccaacgcccacccactcgctaaccg

SEQ ID NO: 417263 - DNA, 832 bp, Homo sapiens
  misc_feature: GZ8MTXP01DUU58.19.78.H01.1.454.CMB.2.raw
  modified_base (280)..(280): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacacatacaaccaaataaacnccccaaatcatcattatgtatcgaccaactaacggccggtacccctttacggtaacgggggtttttacctaaacgttccggtccttttcccgttacccgttcggggtacctttaacccgtaaaacggtttcccgttaaacgggggaaccctaaacccggtaacccgggtcccccttaccccgttaaggaaaccctaaagttcccgtaccgttcgggggcccttaccccggaagggtccttagggaacgggacggtaacggtccgttaggtaacttaaccgtacttacgggtccttagtaccgtttaccgaatttaacgttcggacccggttaagggttccgtttaacttccgttttaaccttttaaagttccgggtttcccggtttaaaaccggggttaaacccggttacggggggtaaacccttaaaccggggttccccgtaaaccccggtttacccggttaacggggttacccaaccccgggtaaaccccgaaaccgggttaaccccccaaaacccccgttctttaaccggttaaccccgtttaaccccg

SEQ ID NO: 417264 - DNA, 709 bp, Homo sapiens
  misc_feature: GZ8MTXP01ANXA2.19.78.H01.1.454.CMB.2.raw
  modified_base (197)..(197): a, c, t, g, unknown or other
  modified_base (207)..(207): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccntctcctgcactggaaccagcagtgatgttagaattctaacttgtctctgtaccaacatacaaccaaataaacaccccaaactcatcatttatgatcgaccaacgtaacgccggtacccttcggtaacgggggttttactaaacgttccgtctttcctccgtcggtctacctaagtcgtaacgggaccaacccgtacgggtcccctacccgtacgtacctaactcgtcgtcgggcctaccgagggcctaggacggacggagggtctacgtaatttaccgacttcggtccttagggtacttacgtaattacgtacgtaccgtaggttaccgttaactttcccgttatttaacgttcgttaaccgttaaccgggtaaaccggtttcggggaaacccgttaacgggtcccgttaaccccggttccgttacgggttacccgaacccgggttaccccgaaccgggtacccccaaccccgttaacgttccggttaacccttaaccccgg

SEQ ID NO: 417265 - DNA, 561 bp, Homo sapiens
  misc_feature: GZ8MTXP01B7GE0.19.78.H01.1.454.CMB.2.raw
  modified_base (262)..(262): a, c, t, g, unknown or other
  modified_base (295)..(295): a, c, t, g, unknown or other
  modified_base (435)..(435): a, c, t, g, unknown or other
  modified_base (547)..(547): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctactgtctctgtacaanatacaccaaataacgccccaaatcatcattatnatgccactaagccgtccctcgtaggggtttactaatcgcttctcctggctccaagtctagccaacacggccctccctgactatctacgtcgggctccgaggctggaggacgaggtctagtaattctactgtcctggctanacttagtgtaccgtggtccgttattcgtctttagtcgttcgttaacggtaacgttcgggaccttaaaggtcctaaccgttccttgggttcaacgacccgaacgcccaacccncttcgcgttaaccc

SEQ ID NO: 417266 - DNA, 611 bp, Homo sapiens
  misc_feature: GZ8MTXP01A3JL0.19.78.H01.1.454.CMB.2.raw
  modified_base (247)..(247): a, c, t, g, unknown or other
  modified_base (265)..(265): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaaccttgtctcctgtaccaacatacaaccaaataacnccccaaatcatctattangatcgccaactaagccgcctgtagggtttacatcgcttctcgtggcctacaagtctaggaccaacgaccggcctacccgtagacctaactcccgtcgtcggctccgaggtccgtagcggacgagggtccttagtacttacgacgtcgcctgctacgatatgacgtaggttctatctcttagtcgttaccgtacggggaacgtcggggaacctacgggtacctaccgtcgttacggaccaccgtaccccgaacggacccaacccgtctcgttcctcttccgtaccgtccccttaacccgttccttaccgaacggtacgtaacgttacgcggacgtccgggcgaaggg

SEQ ID NO: 417267 - DNA, 559 bp, Homo sapiens
  misc_feature: GZ8MTXP01B34KI.19.78.H01.1.454.CMB.2.raw
  modified_base (224)..(224): a, c, t, g, unknown or other
  modified_base (418)..(418): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttagaattctaacttgtctctgtaccaacatcaccaaataaacgccccaaactcatcatttatgatgccactaacgccggccctctagggggtttctaatcgcttctcctggctcagtctggacaacacgcctccctgactaatctctgggctccaggcgtggaggacgaggtctagacgttacnctacgctaggcttacattagtgcgtaggttcgtacttcgttacttattcgtcgttaacggtaacgttcgggtaacacggttctaccggttacgttggttccaaccggtccaacggccccaacccgttctgttccgttaacc

SEQ ID NO: 417268 - DNA, 675 bp, Homo sapiens
  misc_feature: GZ8MTXP01EZ198.19.78.H01.1.454.CMB.2.raw
  modified_base (225)..(225): a, c, t, g, unknown or other
  modified_base (302)..(302): a, c, t, g, unknown or other
  modified_base (391)..(391): a, c, t, g, unknown or other
  modified_base (430)..(430): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcacatctcctgcactggaaccngcagtgatgttagaattctaaccttgtctctgtaccaacatcaacccaaactaaacgaccccaaactcatcatttangatcgccaacgtaacgccggcccttcgtagggggtttactaacgttcgctttcgtccgtcggctacccaaagtcctaagggaccaaccnccgggtccctcccgtgaccaatctcgtggctccaggtcnggaggaccgaggtctagtattacctacgtctcgtcgtacttcaattacgttggaccgtaacgggttccgttaaattccgttacctttaagtcggttttaccggttaacccgggtaaaccggtttcggggaaaccccgttaaaccgggttacccgtaaccccggttccgttaccgggttaccgaacccgacccccgaaaaccggcccccttaaaacccccggaccttccggttcctttaacccccg

SEQ ID NO: 417269 - DNA, 627 bp, Homo sapiens
  misc_feature: GZ8MTXP01B93IA.19.78.H01.1.454.CMB.2.raw
  modified_base (255)..(255): a, c, t, g, unknown or other
  modified_base (265)..(265): a, c, t, g, unknown or other
  modified_base (269)..(269): a, c, t, g, unknown or other
  modified_base (276)..(276): a, c, t, g, unknown or other
  modified_base (279)..(279): a, c, t, g, unknown or other
  modified_base (284)..(285): a, c, t, g, unknown or other
  modified_base (288)..(288): a, c, t, g, unknown or other
  modified_base (307)..(307): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccagcagtgatgttagaattctactgtctctgacantacaccaaanaacncccaatnatnattannatnacacagcgcctgtaggttnatcgtcttctctgctcgagtctagaccaacgaccgtccctaccgtagactaacttcgtaccgtcgggccttaccgaggtcgtaggaacgggacggaggtactaggtaactttaaaccgtacttggtccttcggggtacttacgtaaagtacgtttcggaacccgttaagggttccgttaactttccttacgtttaagttcggttaccggttaaccggtaaacggttacgggtaaccgttaacggtcccgtaacccggttaccgttacgttaccgaacgaccccaaaccggaccccaacccgttactccgttcctaacccg

SEQ ID NO: 417270 - DNA, 684 bp, Homo sapiens
  misc_feature: GZ8MTXP01BQ7H2.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaaccaaataacgccccaaatcatctatttatagatcgaccactaacgccggtacccttcgtaggggtttctaatcgtcttctcctcggctacgagtctacggccaacgaccgccctccctgaactactctcgtcgggctaccgaggcgtaggacggacgaggtctagtacttactacgtcgccttaggggccttacaagttacgtcggtaccgtacgggtttacttaacttccttacgtttaacgttccggtttaccgttaaccggggtaaaccgttccgggggtaaacccgttaaccgggttaccgtaaccccgggtttccggtttaaacgggttacccgtaaacccgggtacccccgtaaaaccgggacccccctaaaaccccggttcccttaacggttaacccctttaaccccg

SEQ ID NO: 417271 - DNA, 649 bp, Homo sapiens
  misc_feature: GZ8MTXP01B7GJC.19.78.H01.1.454.CMB.2.raw
  modified_base (325)..(325): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttggaaattctaacttgtctctggtaccaacatacaacccaaataaacgccccccaaactcatcatttatgatgccaactaacgcggccctntagggtttctaatcgcttctctggtctccaagtctacgggacaaccgtaccgggcccttaccctgacctaactcgtcctggggccttccgaggccttaggacggaacggagggtccttggaacttacctaacgttcgactcggggtacctctacttaagtcggcctagggttacttaacttcgtttacctttagttccgttcgttaaccggggtaacttcgggggaaacccgttaagggtccccgtaaccgttcccgttaggttcccgtaaccgccccgaaacgggacccccaacccgttacttccggttaaccgttaaccccg

SEQ ID NO: 417272 - DNA, 671 bp, Homo sapiens
  misc_feature: GZ8MTXP01EY59B.19.78.H01.1.454.CMB.2.raw
  modified_base (265)..(265): a, c, t, g, unknown or other
  modified_base (282)..(282): a, c, t, g, unknown or other
  modified_base (289)..(289): a, c, t, g, unknown or other
  modified_base (415)..(415): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaaccagcagtgatgttagaaattctaacttgtctctgtacanatacaaccaaataaacncccaaancatactattatagatcgaccaactaaacgccggtacccttacgtaacgggggtttactaaacttccgtctttactccgtcggtactcgaaagtctaagggaccaaccaccgggtccctcccgtaanactactcgtcgtcggactacgaggtactaggaacggacgtaggtactagtaacttacgtactcgtactcggtctaacgtaattagtcgtacgtacggttacttacttacgttacttacgttacggttacgttaacgggtaacggttaccgggtaaaccgttaaacgggtacccgtaaccgttacgttacggttaccgaacccggtaacccggtaaacccgtacccctaacccgttacgttccgttaaccgtaaccg

SEQ ID NO: 417273 - DNA, 691 bp, Homo sapiens
  misc_feature: GZ8MTXP01D8KJT.19.78.H01.1.454.CMB.2.raw
  modified_base (292)..(292): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaattctaacttgtctctgtacaacactacaaccaaataacgaccccaaatcatntaattatgatcgaccaactaacgccgcccttacggtagggtttactaacgtccgtcttctccgtcggtctaccgaagtctaccgggacaaccgccggtccctccctagactactcgtcgtcgggcctaccggagtcctaggaacggtacgacggtctacgtaacttacgtactcgtcgttggtccttactaagttacgtcggtaaccgtacgggtttacttaacgtttccttaacgtttacgtttaccggttaccgttaaaccgggtaaccgggttaccggggtaaacccgttaaacgggggtcccctaacccggttacccggttacggacccgaaacccggtaacccgaacccgtacccccggtaacccttaccttaaccggttaacccgtttccccg

SEQ ID NO: 417274 - DNA, 632 bp, Homo sapiens
  misc_feature: GZ8MTXP01CLK1D.19.78.H01.1.454.CMB.2.raw
  modified_base (223)..(223): a, c, t, g, unknown or other
  modified_base (296)..(296): a, c, t, g, unknown or other
  modified_base (522)..(522): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccngcagtgattgttagaattctaacttgtctctgtaccacatacaaccaaataacaccccaaatcatacatttangatcaccaactaacgccgtcccttagtacgggtttactaactcgtacttctacctcggactccgtaagtccgtaagggacccaaccgccgggtaccctacccttacggaacaacttcgtcgtcgggtcctaccgagggctagggaacggacgtagggccttagacgttactacgtgtctcggctatacttaagtcgaacgtcggtttactacttctactttcggtnttccggtaacggtaacgttacgggaacgttacggtaccgtacccgttaccgttacggttacccaacggtaccccaacggacccctaacccacgtcgttaacccgttcccg

SEQ ID NO: 417275 - DNA, 755 bp, Homo sapiens
  misc_feature: GZ8MTXP01EU0ZV.19.78.H01.1.454.CMB.2.raw
  modified_base (253)..(253): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttntctctgtacaacatacaaccaaataaacgaccccaaactcatactatttatgatcgaccaacgtaacgccggtcccgtacgtacggggtttactaactcgtcttactccgtcggtctaccgtaacgtctacggacaaccgtaccggacccttccctacgaacctaacgtccttacgtcgggtctaccgaacggtcgtaggaacgggtaacggagggtccttaggtaacttaaccgtaacgttacgtcggtctacgttactaagttacgtacggtacgttacggggttaccttaacgtttccgtttctttaaacggttcggtttaacccggtttaaccggggttaaacccggtttacgggggaaaccccgttaaacggggtttacccgtaaaccccgggttcccggttaaacgggttaccccgttaacccgggtacccccgaaaaccgggtaccccccctaaaaccccgttccggtttaacccgttaacccgtttaacccccg

SEQ ID NO: 417276 - DNA, 587 bp, Homo sapiens
  misc_feature: GZ8MTXP01CS22F.19.78.H01.1.454.CMB.2.raw
  modified_base (265)..(265): a, c, t, g, unknown or other
  modified_base (281)..(281): a, c, t, g, unknown or other
  modified_base (298)..(298): a, c, t, g, unknown or other
  modified_base (371)..(371): a, c, t, g, unknown or other
  modified_base (374)..(374): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtaccaanatcaaccaaataaacnccccaaatcatcattangatgccacaagcgccctgtagggttcaatcgtcttctctggctcaagtctagcaacacgcctccagacaatcncgnggctccgaggctggacggacgaggctagtaattacgtactcgtctacggcttactatagtagcgtacggtcgttaaattccttattaacgtcgttacgttaacgggtaaacgttcgggtaacccgttaaaggttcccgtaaccgttacccgttacggttacccgaacgaccccgaacggaccccaaccccgttacttccgttaacctaacccg

SEQ ID NO: 417277 - DNA, 593 bp, Homo sapiens
  misc_feature: GZ8MTXP01A125T.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatacaacccaaataaacgaccccaaactcatactatttatgatcgaccaactaacggccggtaccctcgtaacggggtttctaactcgtcttctcctggctccaagtccgtaaggaccaaccgaccggtccctccctagaacctaatcgtcgtcgggcctaccgaggctggaggacgtacggctagtacttactactgctggctacatacgtgacgtaggttcttactcttcgttattcgttcgttaacggtaacgttcgggtaaccacggtcctaccgttccgttagttcgaaccgacccgaacgaccccacccactcgttcctaaccg

SEQ ID NO: 417278 - DNA, 597 bp, Homo sapiens
  misc_feature: GZ8MTXP01BYQBJ.19.78.H01.1.454.CMB.2.raw
  modified_base (261)..(261): a, c, t, g, unknown or other
  modified_base (272)..(272): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaanatacaccaaanaaacaccccaaactcatcatttatgatgaccactaacgccggacccttcgtaggggtttactaactcgtcttctcctggtctcaagtctcggacaacgacgccctcctcgactactctcgtacggctccgaggctggaggacgaggtctagacttactactgtctcggctctaatagtggactacgggttacttacttcttacgtttatcggtttcgttaaccggtaacggttacgggaaccgttaacggtaccgtacccggttaccgttacggttcgtaaccgacccgaaccgaccccaacccttacctcggttccttaacccg

SEQ ID NO: 417279 - DNA, 723 bp, Homo sapiens
  misc_feature: GZ8MTXP01DN4B7.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgattgtagaaacttctaacttgtctctgtacaacatacacccaaataaacgccccaaatcatctattatgatcgaccaactaacgccggtaccccgttcgtaacgggggttttctaaacgttccgtctttcctccgtcgggaccttaccgtaaacgtcgtaacggaccaacgacccggtccctaccctagaacctaacttcgtccgtcgggtccctccgtacggcgttacggacgggaacggtaggtacgttacggtaactttaaccgtacgttacgtccgttgggaccttactaaagtttacgcggtaaccgtacgggttacgttaaacttcctttcgtttaacgttcggttacgtttaaccgggtaacgttacggggaaacccgttaacgggtacccgtacccggttacccggttacggttacccgtaacccggtaccccgtaaacgggacccccaaaccccgttaccgttccggttcccgtttaaccccg

SEQ ID NO: 417280 - DNA, 511 bp, Homo sapiens
  misc_feature: GZ8MTXP01BEVX2.19.78.H01.1.454.CMB.2.raw
  modified_base (372)..(372): a, c, t, g, unknown or other
  modified_base (436)..(436): a, c, t, g, unknown or other
  modified_base (451)..(451): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccaacatcaacccaaataaacgcccccaaactcatcatttatgatgccactaagccggccctacgtaggggtttctaatcgtcttctcctggctccaagtctaggcaacncggccctccctgacaatctctgggctcaggctgaggacgaggctgattactatgctggctcatntgcaggtctatcttntatgtctgaattggacagtccacgttcgttagcaacgccaaggcccaccgactgctaacc

SEQ ID NO: 417281 - DNA, 769 bp, Homo sapiens
  misc_feature: GZ8MTXP01AQZVP.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtacaacatacaaccaaataacaccccaaactcatactattatgatcgaccaacgtaacgccggtaccctcgtaggggtttactaatcgtctttctccgtcggtctacaacgtctacgggacctaaccgaccggtccctacccgtagaacctaaactcgtccggtcggggtccttacccggaagggtccgttagggaacggggtaacccggtacgggtcgttacgggtaaactttaaccgtacgttcgtccgttacggggtaccttacgtaaacgttacggttacggtaccggttaacgggtttacccgtttaactttccgtttaccgttttaaacggttccggtttacccggtttaaccgggggtaaaccgtttacggggggtaaaccccttaaaccggggttaccccgttaacccgggtttacccgttacgggttaccccgtaaaccggaccccgtaaacccgggaccccctaaacccccgttaacgttcccggttaacctttaacccccg

SEQ ID NO: 417282 - DNA, 645 bp, Homo sapiens
  misc_feature: GZ8MTXP01EZHK5.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacacatacaccaaataaacgaccccaaactcatacatttatgatcgccaactaacgcgccctcgtagggggtttactaatcgtcttctcctggtctccaagtcgtacggaccaacgaccggtcctacccgtgaactaactctcgtcgggctccaggctaggaggacgagggtcctagtacttactacgtcgtctcgggactacattagtgacctaggggttaccgttaatttccgttactttaagttcggttccgtttaacggggtaaaccgtttcgggggaaaccccttaaacgggtccgttaacccggttacccgttacgggttaccaaccggaccccgaaccgggaaccccaaccccgttactaaccggttaaccttaaccccg

SEQ ID NO: 417283 - DNA, 602 bp, Homo sapiens
  misc_feature: GZ8MTXP01CB69D.19.78.H01.1.454.CMB.2.raw
  modified_base (367)..(367): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataaacgcccccaaactcatcatttatgatgccactaacgcggccctcgtaggggtttctaatcgcttctcctggctccaagtctgcaacncgcctcctgacatctctggctccaggctgaggacgaggctagattactactgctggtctacgattagtgccgtagggttcgttacttcgttccttattcgttcgtttaacggtaacgttcggggaacccttaaagggttccctaacccggttacccgttacggggttccctaacggacccccgtaaaccgggtaccccaaacccccgttaccgtaacgttaacccgttaaccccg

SEQ ID NO: 417284 - DNA, 577 bp, Homo sapiens
  misc_feature: GZ8MTXP01BVBSH.19.78.H01.1.454.CMB.2.raw
  modified_base (280)..(280): a, c, t, g, unknown or other
  modified_base (300)..(300): a, c, t, g, unknown or other
  modified_base (451)..(451): a, c, t, g, unknown or other
  modified_base (470)..(470): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgacaacatacaaccaaataaacnccccaaactcatctatttangatgccaactaacgccgcccttacgtagggtttctaatcgacttctcctggtactaccgaagtctaacggaccaaccgaccggtccctccctacgaacctaattcctcgtcgggcctaccgaggctaggaggacgaggctagattactacngtctggctctatatcgcgnggttctatcttcttatcgttcgttaacggaacgttgggaaccttacggtaccgccgttaccgttagttccgaacgcccaacggtccccaaccttctcgttctaaccc

SEQ ID NO: 417285 - DNA, 749 bp, Homo sapiens
  misc_feature: GZ8MTXP01BJFY2.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacaacatacaaccaaataaacgaccccaaactcatactaattatagatcgaccaactaacggccggtaccccttacggtaacgggggttttacctaaacgttccgtctttccgtccgtacggtcctacccgtaaagttcccgtaacgggacccaaccgacccgggtccccttaccccgttacgaacctaacgttccgttaccgtcgggtccgtaccgtacggacggtaggaacgggaaccggacgggtacgttacggtaacgttaacttaacgttcggtccttcggggtacttacgtaattagtacccccccccgtagttacggttacgtttactttacgtttacctttacgtttacgttcggttaaccgggtaaacggttacggggtaaccgttaaaccggtaccgtaacccgttacccgttacggttaccgtaaccggtaccccgaaccggaccccaaccccgttaccgttccgttcccgttaacccg

SEQ ID NO: 417286 - DNA, 794 bp, Homo sapiens
  misc_feature: GZ8MTXP01BY354.19.78.H01.1.454.CMB.2.raw
  modified_base (196)..(196): a, c, t, g, unknown or other
  modified_base (221)..(221): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctctggacngtcgtcacatctctgcactgaaccngcagtgatgttagaaattcctaacttgtctctgtaccacatcaaccaaataacgaccccaaactcatcattatgatcgccaactaacgccggcccttacgtagggggtttctaacgtcgtacttctaccttcggctccgaagtcctacgggtaccaaccgaccgggtcccctccctacggtaacctaaacttcgtacgtcggggtcccttacccggaagggtccttagggacggggtaacggacgggtacgttacgggtaactttaaccgttaacgttcgtcccgttcgggggttaccgttactaacgtttaacgttcgggtacccgttaaacgggggtttcctttaaaccgtttcctttaccgttttaaacgtttccggtttacccgggttttaaaccgggggtaaaaccgtttacggggggttaaaccccgttaaaacggggtttaccccgtaaccccgggtttaccccgtttacgggggttacccctaacggggtacccccccgaaaaccgggggtacccccctaaaacccccccgttaaccgttccgggttaaccccgtttaacccccg

SEQ ID NO: 417287 - DNA, 592 bp, Homo sapiens
  misc_feature: GZ8MTXP01DVNVI.19.78.H01.1.454.CMB.2.raw
  modified_base (259)..(259): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaactgtctctgtacanatcaccaaataacgccccaaatcatcatttatgatcgaccactaacgcggtccctcgtaggggtttctaacgtcgcttctcctggctccaagtctaggacaacgacgtccctccctagacactctcgtcgggctccgagctaggaggacgaggtctagacttactatgctggtctactatagtgctaggtcttatcttctttagtcgttcgttaacggaacgttcggggtaaccgttaacggtaccgtacccgttacccgttacgggttacccaaccggaaccccgaaaccgggaccccaaaccccgttacttccggttaacctttaaccccg

SEQ ID NO: 417288 - DNA, 596 bp, Homo sapiens
  misc_feature: GZ8MTXP01EJJ7I.19.78.H01.1.454.CMB.2.raw
  modified_base (234)..(234): a, c, t, g, unknown or other
  modified_base (264)..(264): a, c, t, g, unknown or other
  modified_base (275)..(275): a, c, t, g, unknown or other
  modified_base (301)..(301): a, c, t, g, unknown or other
  modified_base (399)..(399): a, c, t, g, unknown or other
  modified_base (579)..(579): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtnatgttagaattctaacttgtctctgtacanatcaaccaaanaaacgccccaaactcatctaatttangatgccactaaagcggccctgtaggggtttactaatcgcttctcctcggctccaagtcgtggccaacgacggtcctccctgactaactcgtctgggcnccgaggctggaggacgaggctgattactactgctgggtctactatagttacgacgtacggtttccgttaattccttacgtttaagttcgttccgttaacggtaaacgttcgggaaaccttaaacggtctaacccggttcgttacggaccaacggaccccgtaaccggcccctaaaccccncgtccgttaaccgtccg

SEQ ID NO: 417289 - DNA, 571 bp, Homo sapiens
  misc_feature: GZ8MTXP01BXYPA.19.78.H01.1.454.CMB.2.raw
  modified_base (290)..(290): a, c, t, g, unknown or other
  modified_base (306)..(306): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgtgaaatctaactgtctctgtacacatacaccaaataacgccccaaatcatctatttangatgcatagcgccctnagggttctatcgcttctcctggctaccagtctaggcaacgacggccctcctagacaactctcgtggctcgagctgaggacgagtctagtattactagtgctggactcgaatagtgaccgtaggtcttattcgttacttagttcgttcgtcggtaaacgttcgggaacccgaacggttccgtaacccgttcccggttaacggacccgtaaccgaaccccggtaaacggaccccctaaccccgttacgttccgttccgttaaccccg

SEQ ID NO: 417290 - DNA, 617 bp, Homo sapiens
  misc_feature: GZ8MTXP01BKMQF.19.78.H01.1.454.CMB.2.raw
  modified_base (221)..(221): a, c, t, g, unknown or other
  modified_base (243)..(243): a, c, t, g, unknown or other
  modified_base (287)..(287): a, c, t, g, unknown or other
  modified_base (291)..(291): a, c, t, g, unknown or other
  modified_base (354)..(354): a, c, t, g, unknown or other
  modified_base (422)..(422): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctctgcactgaaccngcagtgatgtagaattctactntctctgtacacatacaccaaataacgccccaaatcatctattangacnccactaacgcgtccctacgtagggtttactatcgtcttctcgtcgctacaagtctgaaccacncgcctcctgacatctcgtgggcctcgaggctaggacggacgtaggctagtaacttaccgtactcggtntacgctactatagtcgacgtacgggttcttaattccttacgttagttcggttcgttaccgggtaaacgtcggggttaaaccctaacgggttccgacccggttaccgttacgggttcccaaccgggaacccccgtaaaccgggttcccccaaacccccgttacgttaccgtaacccgttaacccgtttcccccggg

SEQ ID NO: 417291 - DNA, 651 bp, Homo sapiens
  misc_feature: GZ8MTXP01A5OJE.19.78.H01.1.454.CMB.2.raw
  modified_base (265)..(265): a, c, t, g, unknown or other
  modified_base (299)..(299): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcacgtggaaccagcagtgatgttagaaattctaacttgtctcctgaccaanctacaaccaaataacgaccccaaatcatcattangatgaccaactacgccgtccctagtacgggtttacaacgttcgtacttctaccgtggtctacctaagtcgaacggccaaccgcggtccctcctacgactaactccgtacgcgggtctaccgaaggcgtaggacgggaacgtagggtactaggtaacttaccgtaactggtcctacggggtcttacgacgttactacggtaccgtaggttaccgttaactcccgtttatttacgtacgtttcgtaaccgggttaaagttccgggggtaaacttacgggttacctacccgggttacgttccggaccaacggtaccccaaagggcccctaacccggttctcgttaacctaacccg

SEQ ID NO: 417292 - DNA, 665 bp, Homo sapiens
  misc_feature: GZ8MTXP01DQ8TS.19.78.H01.1.454.CMB.2.raw
  modified_base (230)..(230): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtgggtctccgtggacaggtccggtacaccatctcctgcactggaaccngcagtgatgtagaaattctaactgtctctgtaccaacactacaaccaaactaaacgacccccaaactcatactaatttatagactcgaccaactaacgccgcccttgtagggtttactaactcgtcttctcctggctacgaagtctacggaccaacgaccgtccctacccgtagacctaactcgtacgtcgggtccctaccggaggtcctaggacgggacgtacggtacttacggtaacttacgtaactcgtcctacggtcttacgtaagtacgtacggtacgttaacgggttcgttaactttcgttacgtttacgttcggtaccgtttaacggaacgttcggggtaaaccttacggtaccgtacccgttacgttacggttacccgaacgacccctaaccggacccctaacccgttactcgttccgttaaccccg

SEQ ID NO: 417293 - DNA, 631 bp, Homo sapiens
  misc_feature: GZ8MTXP01BPB6P.19.78.H01.1.454.CMB.2.raw
  modified_base (264)..(264): a, c, t, g, unknown or other
  modified_base (279)..(279): a, c, t, g, unknown or other
  modified_base (452)..(452): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtcctgccctgactcagtctgcctccgtgtctgggtctcctggacagtcggtcaccatctcctgcactggaaccagcagtgatgttagaattctaactgtctctgtacanatcaaccaataaacncccaaatcatcatttatgatgaccactaacgcgcctcgtagggtttctaagtcgtcttctcccgtggtctacctaagtccgtaagaccaacgaccggtccctccgtagaacctaactcgtcgtacgggctcgacggcgtaggacggaacggaggtcctagtacttacttacgngtctcgtactactagtacgtacgtcgtacggttacttacttcgttacgttacgttcggttacggttaaccgggtaacggttacggtaaccgttaacggttaccgtaaccggttacgttacgttacccgaaccgaccccgaaccgacccctaacccgttacgtaaccgttaacgtaaccg

SEQ ID NO: 417294 - DNA, 705 bp, Homo sapiens
  misc_feature: GZ8MTXP01C8GLE.19.78.H01.1.454.CMB.2.raw
  modified_base (194)..(194): a, c, t, g, unknown or other
  modified_base (199)..(199): a, c, t, g, unknown or other
  modified_base (687)..(687): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggccagtctgccctgactcagtctgcctccgtgtctgggtctccgnggacngtcgcaccatctcctgcactggaaccagcagtgattgtagtaacttctaactgtctctgtacacatacaaccaaataaacaccccaaactcaatctaattatagatcgacctaactaacggccgtcccgttacggtacggggtttactaacgttcgtacttctacccgtcggtactccgtaaagtccgtaacgggtaccaaccgtacccggtccctacccgtagaacctaacgttccgtccgtacgggtcccttaccggacggtacgttacgggaacggaacccggtaaggttccgttaaggttaaaccttaaccgttacgtcgtccgttaacgtcccgttaataacttacggtgtacccgttaagggttcccttaattccgttacttagttccggttacgttaaccgggaacgttcggggtaaccttaacggtccgtaccgttacgttacggttaccgaacgaaccccgtaaccggaccctaacccncgttaacgccttaacccg

SEQ ID NO: 417295 - DNA, 631 bp, Homo sapiens
  misc_feature: GZ8MTXP01AT73V.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaaccagcagtgatgttagaaattctaactgtctctgacaacatacaaccaaataaacgaccccaaactcatctatttactgatcgaccactagccgtcctacgtagggtttactaactcgtcttcgtccgtcggtctaccgaacgtcgtacggtaccaaccgtaccgggtccctccctagacctaactcgtctcgggcctcgagcgtacgaggacgaggctagtaattacctactgtacgtgccttatagttactcgtccgtagggtcctttacttacgttcgtttatcggtttacgttaacgggtaacgttacggggtaaccttaacggtaccgtaaccggttccgttaacgttcgaaccgacccgaaaccggtacccctaaaccccacggttcgttaacccgtttaaccc

SEQ ID NO: 417296 - DNA, 551 bp, Homo sapiens
  misc_feature: GZ8MTXP01AOWYV.19.78.H01.1.454.CMB.2.raw
  modified_base (196)..(196): a, c, t, g, unknown or other
  modified_base (223)..(223): a, c, t, g, unknown or other
  modified_base (424)..(424): a, c, t, g, unknown or other
  modified_base (460)..(460): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctactcactcaggacacagggtcctgggcccagtctgccctgactcagtctgcctcgtgtctggtctcctggacngtcgtcaccatctcctgcatggaaccngcagtgatgttagaaattctaacttgtctctgtacaacatcaaccaaataaacgccccaaatcatcatttatgatgcactagcgccctcgagggtttctaatcgtctctcctggctacaagtctaggacctaacacggccctcctgacatctcgtacggtctccgaggcgtagaggacgaggtcctagtacttactaacgngtcctgggtactctatacttcggcgtagtaccgttnttcttgttacgtcgtcgtaacggtacgttacggtacgttacggtcctacgttcgttcggccaacgaccgaacgaccctaccttctcgctcg

SEQ ID NO: 417297 - DNA, 632 bp, Homo sapiens
  misc_feature: GZ8MTXP01BKCII.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaacttgtctctgtaccaacatacaaccaaataaacgaccccaaactcatactatttatgatcgaccaacgtaacgccggtacccttacgtacgggggttttactaacgttcgtctttctccgtcggtctacctaagtcctacgggaccaaccgaccggtccctaccctacgacctaactctcgtcgggtctacccgaggcgtaggacggacgaggtctagtaacttactacgtgtctcggtctacgtaatagtcgtccgtaagggttcttacttcttccttagttcgttaccggttaacgtaacgggttacggtaaccgttacgtaccgtaccgttcgttacgttcgaaccaccgaaccgacccgacccaccgtcgttaaccgtccg

SEQ ID NO: 417298 - DNA, 655 bp, Homo sapiens
  misc_feature: GZ8MTXP01A6XDU.19.78.H01.1.454.CMB.2.raw
  modified_base (196)..(196): a, c, t, g, unknown or other
  modified_base (224)..(224): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcgtcaccatctcctgcactggaaccngcagtgatgttagtaaattctaacttgtctctgtaccaacatacaaccaaataaacgaccccaaactcactactatttatagtatcgaccacgtaaacgcggtcccttacgtacgggggtttactaacgtcgtcttctcccgtcggtctactacgtctacgacaacgcgtccctcctagactaatctcgtcgggctaccgaggcgtgaaggacgaggctagtacttactactgtcctggtctactattacgtggactacgggttcttactttcctttacttaagttcgttaccggtttaaccgggtaaacgttaccgggggtaaaccttaacgggttccgtaacccggttaccggttacggttaaccccgtaacgaccccggtaaaccggacccctaaacccccggaacttcccgttaaccgttaaccccg

SEQ ID NO: 417299 - DNA, 650 bp, Homo sapiens
  misc_feature: GZ8MTXP01ALY84.19.78.H01.1.454.CMB.2.raw
  modified_base (197)..(197): a, c, t, g, unknown or other
  modified_base (225)..(225): a, c, t, g, unknown or other
  modified_base (249)..(249): a, c, t, g, unknown or other
  modified_base (275)..(275): a, c, t, g, unknown or other
  modified_base (291)..(291): a, c, t, g, unknown or other
  modified_base (296)..(296): a, c, t, g, unknown or other
  modified_base (363)..(363): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacgagggtcctgggcccagtctgccctgactcagtctgcctccgtgtctggtctccgtggacngtcgtcaccatctctgcacgtggaaccngcagtgatgttagaattctacttntctctgtacacacacaaccaataacncccaaatcatcattangatcncactacgcgccctagtaggttctagtctcttctccgtgactacagtcgcgacaacgccgctcccgtnacatctcgtcgtctcgaggtcgtaggacggtacgacgtactagtacttaaccctcgtcgtaccgttcggacttaccgtagttacgtaccggtaccgtgggtttacttaaccgtttcctttaccgtttagtttccggttacccggtttaaccgggaacggttacccggggtaacccgttaaaccggttacccgtaccccgggttacgttacggaccccgtaacccggaccccgtaaacccgggtaccccctaaccccgttacgttcgggttaaccctttaaccccggg

SEQ ID NO: 417300 - DNA, 688 bp, Homo sapiens
  misc_feature: GZ8MTXP01B10XG.19.78.H01.1.454.CMB.2.raw
  modified_base (219)..(219): a, c, t, g, unknown or other
  modified_base (225)..(225): a, c, t, g, unknown or other
  modified_base (278)..(278): a, c, t, g, unknown or other
  modified_base (301)..(301): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctcgtgtctggtctctggacagtcgtcacatctctgcacgtagaaccngcagtnatgtagaaattctaacttgtctcgtacgtacaacactacaaccaaataaaccncccaaactcaatactattatgancgaccaacgtaacgccgaccctcgtacgggtttactaacgtcgttcttctccgtcggtctaccgtaacgtcgtaacggaaccaaccgacccgtcctaccctagtaactaactccgtacgtcgggccctacggaacggtcgtacgggaacggaccgtaagggtccttaagtacttaccgtactggtcccttacgtactacgtacgttagtacgtacgtacgttacttacttcgttacttacgttaccggttaacgtaacgggtaaacggttaccgggtaaaccgttaccggtacccgtacccggttacgttaccggttaacccgtaacccgaaccccgtaacccgtaaccccgtaacccgttaccgttaaccgttaacccgtaacccg

SEQ ID NO: 417301 - DNA, 583 bp, Homo sapiens
  misc_feature: GZ8MTXP01EOLJS.19.78.H01.1.454.CMB.2.raw
  modified_base (265)..(265): a, c, t, g, unknown or other
  modified_base (446)..(446): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtccggtcaccatcctcctgcactggaaccagcagtgatgttagaaattctaacttgtctctgtacanatacaaccaaataaacaccccaaatcatactatttatgatcgaccaactaacgccgcccttagtacgggtttactaatcgtcttctcctcggctacgaagtcgtaacgacaaccgccggccctaccctagactaatctcgtcggcctaccgaggctaggacggacgagtctagtattactntgctggactacatagtcgacgtagtcttattcttcgttagtcgttacgttaacggaacgttcgggaaaccttacggtcctaccgttacgttcgaccgaaccgacccgaacgacccaaccttcgtcgttaacctcccg

SEQ ID NO: 417302 - DNA, 656 bp, Homo sapiens
  misc_feature: GZ8MTXP01B616K.19.78.H01.1.454.CMB.2.raw
  modified_base (211)..(211): a, c, t, g, unknown or other
  modified_base (275)..(275): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctcgggcccagtctcgcctgactcagtctcgcctccgtgtcgtggtctccgtggacagtcgcaccntctctgcacgtcgaacagcagtgatgtagtaacttctactgtctctgacacactacaaccaaanaacaccccaaactcatatattatcgatcgaccaacgtaacgccggtcccttacggtacgggtttactaactcgtcttcgtccctggtctacgaacgtcgtaacgaccaaccgaccggtccctccctacgtaactactcgtcgtcggcctcgacggcgtgaacggacggcgtactagtaacttcgtactgactcgggcttacgtatacgtcgtacggtacgttacgttacttaccttagtttacgttcggtttaccggttaacgggtaacgttacgggaaacccgttaacggttacccgtaacccggttacgttccggttaaccaacccggtaacccgtaacccgacccctaaccccgttattcccggttaaccttaacccg

SEQ ID NO: 417303 - DNA, 686 bp, Homo sapiens
  misc_feature: GZ8MTXP01ASN79.19.78.H01.1.454.CMB.2.raw
  modified_base (295)..(296): a, c, t, g, unknown or other
  modified_base (299)..(299): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacaacatcaccaaataaacaccccaaatcatcattannatnccataagcgcctcgtagggttctaatcgcttctccgtcggtctaccgaacgtctacgggaccaaccgaccggtccctccctacgaactaactcgtcgtcgggccttaccgaacgggtcctagggacgggaacggtacgggtactagggtaactttaaccgtaacgttacgtccgttgggtccttaacggtactaacgttcgtaccgtaggggttaccgtttaacgtttccttacgttttaacgttcggtttcccggttaacggtaaccggttacggggtaaacccttaaaggggttacccctaacccgggttaccgttacggttaccaaccggaccccgtaaacggcccccaaacccgttaccgttccggttaaccgtttaaccccg

SEQ ID NO: 417304 - DNA, 781 bp, Homo sapiens
  misc_feature: GZ8MTXP01C9LVE.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgtagaaattctaacttgtctctgtacaacatacaaccaaactaaacgaccccaaactcatactactttatgtactcggaccaacgtaaacgccggtacccctttacggtacgggggtttttacctaaacgttccggtcctttccgtcccgttacgggtaccttaccgtaaacggttccgttaacgggacctaacccgacccgggtccccttaccccgtacgaaaccctaaacttccgtccggtcggggtacccttcccgaacggggtccgtacgggaacgggaacggtaacggtacgttacggtaacgttaacctaacgttacgtacccgttgggtacccttaacctaacgttaagtacggtaccgtacggggttaccgttaaacgttccttaccgtttaagttccggttacggttaaccgggtaaacggttacggggtaaacccgaaacggttacccgtacccgttaccggttacggacccgttaaccgggtaaccccgaaccggtaccccaaaccccgttaacgtttccggaacctttaaccccg

SEQ ID NO: 417305 - DNA, 644 bp, Homo sapiens
  misc_feature: GZ8MTXP01BTETP.19.78.H01.1.454.CMB.2.raw
  modified_base (195)..(195): a, c, t, g, unknown or other
  modified_base (223)..(223): a, c, t, g, unknown or other
  modified_base (257)..(257): a, c, t, g, unknown or other
  modified_base (271)..(271): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcactggaaccngcagtgatgttagaaattctactgtctctgacantacaaccaataacncccaaatcatctatttatgatcgaccaacgtaacggccgtccctagtacgggtttctaagtcgtcttctccgtcggtactacgaagtctacggaccaacgacccggtccctaccgtacgaactactcctcgtcgggtcctaccggaggcgtaggaggtaccggaggtaccttagtaacttactcgtcgtccttaggacttactattaagtcgtcgtaaggttcgttacttcttaacgtttcgttacggttacgttaacgggtaaaccgttacggggaacccgttaacgggtaccctaccggttaccgttacgggttacccaaccgaacccgtaacccggaacccctaacccacgttccgttaaccgttccccg

SEQ ID NO: 417306 - DNA, 817 bp, Homo sapiens
  misc_feature: GZ8MTXP01C4F8B.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccaacatacaccaaataaacgaccccaaactcatactaatttatgatcgaccaactaacgccggtccccgtagtacggggtttactaattccgtctttacctcccgttcgggtaccttaccgtaaacgttccgttaacgggaacccaacccggtacccgggtaccccttaccccgttaggaaccctaaacgttcccgttccggtacgggggtccctttaccggtaaggggttacggaacggggacggaacggggttacccttaagggttaactttaacctaccgttggtaccttacgggtaccctttaagtaactttaacgttccggaccgttaaacgggggttccctttaagtttcttttacccgtttagtttaccgggtttaccgttccgggggtaaaaaccgttcgggggttaaaacccgtaaacggggttccccgtaaaaccgggtttcccgttaaaaccggggttccttaaacccgggtaaccccgtaaacccgggaacccctaaaccccccgttggttaacccgttcccttaaccggttttcccccg

SEQ ID NO: 417307 - DNA, 592 bp, Homo sapiens
  misc_feature: GZ8MTXP01C9GN8.19.78.H01.1.454.CMB.2.raw
  modified_base (195)..(195): a, c, t, g, unknown or other
  modified_base (210)..(210): a, c, t, g, unknown or other
  modified_base (260)..(260): a, c, t, g, unknown or other
  modified_base (272)..(272): a, c, t, g, unknown or other
  modified_base (292)..(293): a, c, t, g, unknown or other
  modified_base (295)..(295): a, c, t, g, unknown or other
  modified_base (418)..(418): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcacatctccngcactggaaccagcagtgattgtagtaaattctaacttgtctctgtacanatacaaccaaanaacgcccaaatcatcattannancacactacgcgtcccttcgtaggtttactaatcgtcttctctcgtctcgtaacgtctaacgacaaccgccgtccctccctagactactcgtcgtcggctcgacggcgtaggacggacgtacgnttagacttactctagtctggtctcgtaatacgtgacgtacggttcttacttccttattacgttcgttcgttaacggtacggttacggtaaccgacggttccgtccggttacgttacgttccgaaccgaccccgaacggacccctacccgttacgttaaccgttccgttaacccg

SEQ ID NO: 417308 - DNA, 637 bp, Homo sapiens
  misc_feature: GZ8MTXP01CWX8K.19.78.H01.1.454.CMB.2.raw
  modified_base (225)..(225): a, c, t, g, unknown or other
  modified_base (264)..(264): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaacttgtctctgtaccaanactacaacccaaataaacgaccccaaactcatcatttatgatcgccactaaacgccgtacccttcgagggtttactaacgtcgtcttctcctggtctcaacgtcaggactaaccgaccggccctaccctacgaaccaacttctcgtcgggcctccgagcctaggaacggacgaggacctgtaacttactactgtcctgggctataactagtacgccgtaaggttcttaattccttactttacttcgtaccgttaacgggtaaaccgttggggaaacccttaagggttaccgtacccggtttaaccgttcgggttaccaaccggaaccccgaacgtacccccgtaaacccgaccttcggttcccgttaaccccg

SEQ ID NO: 417309 - DNA, 657 bp, Homo sapiens
  misc_feature: GZ8MTXP01BPSXY.19.78.H01.1.454.CMB.2.raw
  modified_base (234)..(234): a, c, t, g, unknown or other
  modified_base (261)..(261): a, c, t, g, unknown or other
  modified_base (534)..(534): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtnatgtagaattctactgtctctgtacanatcaccaaataacacccaactcatctatttatgatcgacctaacgtaacgtccggtccccttcggtacgggggttttacttaaacgttccgtctttccgtcctcggtcgttacccaagttccgtacgggacctaaccgacccggtccctacccgttacgaacctaactccgtccgtcggggcctaccgaggaccgtagggaagggtaccgagggtccttaggtaacttacctagttcgcttgggtcctagtataagtcgaacgtggttacttntcttgttatcggttacgtaacgggtaacgttacgggtaacgttaaccgtccgtacccgttcgttacgttaccgaaccgacccgaaacccggccctaaacccgcgttccgttcctttaaccccg

SEQ ID NO: 417310 - DNA, 600 bp, Homo sapiens
  misc_feature: GZ8MTXP01BE740.19.78.H01.1.454.CMB.2.raw
  modified_base (263)..(263): a, c, t, g, unknown or other
  modified_base (436)..(436): a, c, t, g, unknown or other
  modified_base (459)..(459): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactaggaaccagcagtgatgttagaaattctaactgtctctgtaccanactacaaccaaataaacacccaaactcatctattatgatcgcaactaacgccgtacccgtacgtagggtttactacgtccgtcttctccgtcgtctaccgaacgtctaacgaccaaccgccgtccctaccctacgactaactcgtcgtcggctcgagtcgtaggacggacggngtactagtacttactgtcgtcgngtctcgtatagtcgcgttaggttcttactcttcttagttcgttcgttaacggtacgttacgggtaccaacggtccctaccggttccgttacgttaccgaaccgacccgaacccgtaccaccccgttactcgttcctaaccg

SEQ ID NO: 417311 - DNA, 600 bp, Homo sapiens
  misc_feature: GZ8MTXP01EGCWX.19.78.H01.1.454.CMB.2.raw
  modified_base (586)..(586): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttgaaattctaaccttgtctctgtacaacatcaaccaaataaacgccccaaactcatcatttatgatcgccaacgtaacgccggtccctcgtaggggtttactaatcgtcttctcctcggctccaagtctacggacaaccgacgccctccctagacctaactctcgtcgggtctccgaggctgacggacgtacggcgtacgtaattacctaacgtcgtcttcgggcttacagttagttcgaccgtaaggttcgtacttcttactttattggttccttaacgggaacgttcgggtaaccgttacggttccaacccgttcgttagttaccaacgggacccaacgccccaacccnctcgttcctaaccg

SEQ ID NO: 417312 - DNA, 696 bp, Homo sapiens
  misc_feature: GZ8MTXP01BGRJD.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttaggaaattctaacttgtctctgtaccaacactacaaccaaataaacgaccccaaactcatactatttatagtactacgaccaacgtaacgccggtcccgttacggtaacggggttttactaacgttccgtctttccgtcccgtacggtactacccgtaaagtccgtaacggaccctaaccgaccggtccctacccgtacgaacctaactcgttccgcgggtcctaccgaggcgtaggacggacgagtctagtacttacgtactgtctcggacttacgtatacgtcgacgttacggttacgttacttcttcgttagttcgttcgttaaccgggtaacgttacggggtaaacccgttaacggttacccgtaacccggttaccgttacgggttacccgaacccggtaccccgaaacccgggtacccctaaaccccgttacgttcccggttaacctttaaccccg

SEQ ID NO: 417313 - DNA, 569 bp, Homo sapiens
  misc_feature: GZ8MTXP01EGI8N.19.78.H01.1.454.CMB.2.raw
  modified_base (391)..(391): a, c, t, g, unknown or other
  modified_base (395)..(395): a, c, t, g, unknown or other
  modified_base (493)..(493): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaaccaaataaacgccccaaatcatcatttatgatgccactaagcggcctgagggtttcaatcgcttctctggctccaagtctggacaacacggcctccctagacaatcctctgggctccaggctgaaggacgagggctgacttacgtactgcttnctanatatgacgtacgttctactcttacgttacgtacgttacggaacggtacggacgtaacgtccaccgtcgtacgtacaccgacccgaaccgacccacccnctctcacctccgttccgtcccctacccttccgttccacgtaacgtacgtaacgtcggacggcggtcgttcggaacg

SEQ ID NO: 417314 - DNA, 582 bp, Homo sapiens
  misc_feature: GZ8MTXP01BR336.19.78.H01.1.454.CMB.2.raw
  modified_base (226)..(226): a, c, t, g, unknown or other
  modified_base (250)..(250): a, c, t, g, unknown or other
  modified_base (263)..(263): a, c, t, g, unknown or other
  modified_base (452)..(452): a, c, t, g, unknown or other
  modified_base (466)..(466): a, c, t, g, unknown or other
  modified_base (481)..(481): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacgagggtcctgggcccagtctgcctgactcagtctgcctcgtgtcgtggtctccgtggacaggtcggtcaccatctcctgcactggaaccngcagtgatgttagaattctaactntctctagtacaanatacaaccaaaataaacgaccccaaaatcaatcgtaaattatagatcgacctaaacgtaacggcgtaccccgtaggtacgggtttactaacgtcgtcttacgtactcggactacgaagtctaacggactaacgacgccctaccagaacatctctggctcaagtctaggagtaacgagtctgtaataacngtgtcctggactanaatatgacgtaggtntacttctagttatgttactaacggaacgttgggaaaccaaggtaccgacgttcgttaggaccaacgcccgaaacggccccaaccgttctcgttctaacccg

SEQ ID NO: 417315 - DNA, 841 bp, Homo sapiens
  misc_feature: GZ8MTXP01EZK1K.19.78.H01.1.454.CMB.2.raw
  modified_base (274)..(274): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgtagtaaattctaacttgtctcctagtaaccaacatacaacccaaaataaaccgaccccaaactcatctattangatcgaccataacgcggtcctacgtagggtttctaatcgtcttacctctggtcctaccgaaagtcgtacggacaaaccgtaccggtaccttaccccgagtaacctaacttccccgttccgtcggggtacctaccccggaaagggtacccgttaagggaacggggtaacgggaacgggtacccttaaggttaaaccttttaaacctaaccgttcggtaacttcgtacccgttaaacgtaacttaagtccggtaaccgtaaggggtttcccttaaaagtttcccttaccgtttaaagttccgggttttaacccggttaaccggggggtaaacgtttaacccgggggaaacccttaaaccgggttaccccttaacccgggtaacccgttagggttaaccccgaaaccgtacccccgggtaaaacggtacccccccgaaaaccctaacttacggttacccttaaaccccttccggtttaccccgttacccccaccccccgtttccaacccgaaacgggtttaacgaacggtttaaacgtccgggaacgggtccgggttaacgaacccgggg

SEQ ID NO: 417316 - DNA, 862 bp, Homo sapiens
  misc_feature: GZ8MTXP01BKU5Q.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacaacatcaaccaaataacgccccaaactcatactactttatacgtatcgaccaacgttaaacggccggtaccccgttacgtaacggggggttttaccttaaacgttccggtacctttccgttccccgttcgggtaccttacccgtaaaaggttcccgttaacggggaccctaaaccgtaacccgggtccccttacccccgtacggtaaccctaaaacgttccgtacccgtcgggggtcccttacccggaaacggggtccgttacgggaacgggtaacccggtaaacggggtcccttagggttaacctttaaaccggtaaccttcggtaccttcggggttacccttaacgtaatttaacccgtgggtacccgttaacggggtttccgtttaaactttcccgtttaaacttttacgttccgggtttacccgttaaccggggttaaaccggttaccgggggtaaacccgttaaaaccggggttccccgtaaccccgggtttaccccgttaacggggtttaaccccgtaacccggtacccccggtaaaccgggtaaaccccccaacccccggttaaacctcccggtttaaccgttaaccccccgg

SEQ ID NO: 417317 - DNA, 740 bp, Homo sapiens
  misc_feature: GZ8MTXP01DL9BL.19.78.H01.1.454.CMB.2.raw
  modified_base (196)..(196): a, c, t, g, unknown or other
  modified_base (226)..(226): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctccgtggacngtcgcaccatctcctgcacgtacgaacagntagtgtattagttagtaaacttaccttaaccgttcgttcctaccgtacggtaaccaacaactaaccaaaccctaaaactaaaacccgaacccccctaaactacctaattaccttaaatttacgttacgaacttaccgaaaccccgtaacgtaaaccggtcccggtaccccgtttaaggttacggggtttaactaacgtccgtctttcctccgtcggtactactaaggtccgtaacgaccaaccgccggtccctacgtacacctattccgtacgtcggtacctacgcggacgtaggaacggaaccgtggtactagtaacttaactcgtgacccgttgtactatagtacgtacgtacggttacgttacttactttaccttgtttacgttacgttaacgggtaaaccggtacggttaaacgggtaaaccgttacggtacccgtaccggttaccgttacggaccgaacccgaacccgaaccccgtaccctaccttacgttaaccgttaaccttaaccg

SEQ ID NO: 417318 - DNA, 717 bp, Homo sapiens
  misc_feature: GZ8MTXP01ERKMU.19.78.H01.1.454.CMB.2.raw
  modified_base (247)..(247): a, c, t, g, unknown or other
  modified_base (266)..(266): a, c, t, g, unknown or other
  modified_base (701)..(701): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttagaaattctaacttgtctcctgtacaacatcaaccaaataaacnccccaaactcatctattangatcgaccaactaacgccggtaccctcgtacgggtttactaatccgtcttctctggtcctaccaagtcgtcggaccaaaccgaccggtccctaccctagaacctaacgttccccttcggtacggggcctaccgacgggtaacgtacgggaacgggaaccgggtaagggtcctttacggtaaaccttttaacgtaaccgttcggccttacgttccctactaaacgttaagtcggttaaccggtacgggtttacctttacttaccttacgtttaattcggttaccggttacgggggtaaccggtaacggggtaaaccctaacgggtaccctacccgttacgtacgtaaccgaccgacccgaaaccggacccctaacccgaacttcttactcttaccgttccgtccccttacccttccttacccgaagtacaacgtcnggacgcggcgtaacgg

SEQ ID NO: 417319 - DNA, 744 bp, Homo sapiens
  misc_feature: GZ8MTXP01EHQU6.19.78.H01.1.454.CMB.2.raw
  modified_base (266)..(266): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtgatgttaggaaattctaacttgtctctgtaccaanatacaaccaaataaacgaccccaaactcatcatttatgatcgacctaacgtaaacggtccggtaccccgttacgtacgggggtttacttaacgtccgtcctttccgttccctcgggtacctaccgtaaacggttccgtaacgggaccaacccgtaccgggtcccctaccccttacgaacctaacgttcgtccgtcgggtcctacccgagggcctagggaacgggtaacccggagggtacttacggttaacttaaaccgttacgttcgtccggttacgtaccttaacgtaagttacgttcggtaccgtacggggtttactttacttccgtttactttaacgttcgttcccggttaacgggtaaacgttccggggaaacccttaacggggttaccctaacccggttaccgttacggttaccgaacccggaccccaaaccgggtaccccctaaacccgttccgtaacccgttctaaccccg

SEQ ID NO: 417320 - DNA, 807 bp, Homo sapiens
  misc_feature: GZ8MTXP01B9NMJ.19.78.H01.1.454.CMB.2.raw
  modified_base (207)..(207): a, c, t, g, unknown or other
  modified_base (226)..(226): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccntctcctgcacgtggaaccngcagtgattgttaggtaattctaacttgtctacgtgtaccaacactacaaccaaactaaaccgaccccaaactcatactatttactgtatacgacctaacgtaacggtccggtaccccgtttacgtacgggggttttacttaacgttccgtcctttacgttcccgttacgtaccgttaccgtaaacgtcgtaaccgggaccctaaccggacccgggtaccccttcccgtaacgtaaccgtaaccgttccgtcccggttcgggtacccgtaccggtacgggacgttacgggaacggggaaccggtaacggtacgttacggttaaacttaccgttaacgtacgtccgttacggcgtttaacgagtttacgtaccgtaccgtacggtttaccgttaacgtttcgtttactttaacggttccggtttacccggttaaccgggtaaaccgggttaccgggtaaacccgttaaccgggttaccccgtaaccggtttaccccggttacgggttacccgaaccccggaacccccggtaaccggtacccccgtaaccccgttaccgtaacccgttaacccgtttcccccg

SEQ ID NO: 417321 - DNA, 608 bp, Homo sapiens
  misc_feature: GZ8MTXP01BK781.19.78.H01.1.454.CMB.2.raw
  modified_base (299)..(299): a, c, t, g, unknown or other
  modified_base (434)..(434): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaactgtctctgtacacatacaccaaataacgaccccaaatcatctaatttangatgaccactaagccggccctgtagggtttctaatcgcttctcctggctccaagtctacgggaccaacgacccgggtccctcccgtagacctaactcctaccgtggggtcctaccgagggctaggagggaaccgnggtacctgtacttaactcgtacgtcgtgggcttactattaacgttgaccgtggttaccgttattccttactttacttgttccgtaacggtacgttcgggacgttaacggtctacccgttcgttacggttcaaccgaccgtaaccggcccaaacccgcttaaccgccgttaaccg

SEQ ID NO: 417322 - DNA, 627 bp, Homo sapiens
  misc_feature: GZ8MTXP01CDMN4.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctggccagtctgccctgactcagtctgcctccgtgtctggtctcctggacagtcgtcaccatctctgcacgtgaaccagcagtgatgttagaaattctaactgtctctagtaccaacatacaacctaaaataaaccgaccccaaactcaatctaatttaagactatacgacctaacgtaacggccggtacccgttacgttagggtttacctaaacgtccgtcttccttccgtcggtactacgtaagtctaacgaccaacgaccgtccctacccgtagaacaattctcgcggtcacgagctagacggacgaggtctagacttagtactgtctcgtctactactactcgtagtacggtacgttacttacttacttaattcgttacgttaacggtaacggttacggtaacgttaaacgtaccgtaccgttaccgttacggacaaccgaccgaaccgaacccacccttacctaacgttcgtaaccc

SEQ ID NO: 417323 - DNA, 644 bp, Homo sapiens
  misc_feature: GZ8MTXP01AHYZR.19.78.H01.1.454.CMB.2.raw
  modified_base (226)..(226): a, c, t, g, unknown or other
  modified_base (262)..(262): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccngcagtgatgttgaaattctaacttgtctctgacaanatcaaccaaataaacaccccaaactcatcaatttatgatgaccacgtaacgccggcccttcgtacggggtttactaactcgtcttctccgtacggctacccgaagtccgtaagggaccaacgacccggtcccttcccgtacgactaactcttccgtcgggctccgaggccgtaggacgggacgacggtctagtaactttacctacgtgtcctagggccttacgattacgtcgtacgtacggttcgttaacttccttcgtttaagttcgttcggtttaacggaaacggttacggggaacccttaaggtcccgtaacccgttcgttacggttaccgaacgaccccgaacggaccccaacccttacgtcgttaaccgttaacccg

SEQ ID NO: 417324 - DNA, 758 bp, Homo sapiens
  misc_feature: GZ8MTXP01CEJ4A.19.78.H01.1.454.CMB.2.raw
  modified_base (226)..(226): a, c, t, g, unknown or other
  modified_base (300)..(300): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccngcagtgatgttagaattctaacttgtctctgtaccaacatacacccaaataaacgccccaaactcatcatttangatgaccactaagcgccctcgagggtttctaatcgcttctcctggctcaagtctacggccaacgaccggtccctcccgtagaacctaactcgtcgtcggggtccttacccggaagggtccgttagggaacggggaacggtacgggtaccttacgggtaaactttaccgtaacgttcgggtccctttacggggtaccttactaaacgtttaacgttaaaccggttacggggtttacccgtttaaacgtttcctttaccgttttaaagttccgggtttaaccgtttaccggggtaaaaccgttcgggggttaaaccccgttaaacggggttcccgttaaaccccggtttcccggttaaacggggttcccgttaaaccggtaacccccggtaaaacccggggaaccccccgtaaaccccctaaccgttccgggttaaccccgttaacccttttccccccgg

SEQ ID NO: 417325 - DNA, 679 bp, Homo sapiens
  misc_feature: GZ8MTXP01APR8S.19.78.H01.1.454.CMB.2.raw
  modified_base (255)..(255): a, c, t, g, unknown or other
  modified_base (295)..(296): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcacatctctgcactgaacagcagtgatgtagaattctaacttgtctctgtaccaanactacaacccaaataacgaccccaaactcatactatttannatcaccaactacgtccggtaccctagtacgggttttacaacgttcgtcttcctccgtcggtactaccgtaacgtcgtaacgggaccaaccgtaccggtccctacccgtagtaaccctaacgttcttcccggtacgggtaccttaccccggaagggttaccgtagggaaacggggtaaccgggaacgggttaccttaggttaaacttaccgtaacgttcgtacgtacgtctacgtaataacgtcgtaacgtacggttctaaacttccttagtttaacgtcgttccggttaacggaacggttacggaaacgttacgtccgtaccgttacgttggttacccgaaccgacccgtaaccgaccctacccgataaccgttcgtaacccg

SEQ ID NO: 417326 - DNA, 699 bp, Homo sapiens
  misc_feature: GZ8MTXP01BJGH7.19.78.H01.1.454.CMB.2.raw
  modified_base (209)..(209): a, c, t, g, unknown or other
  modified_base (226)..(226): a, c, t, g, unknown or other
  modified_base (311)..(311): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacgagggtcctgggcccagtctcgcctgactcagtctcgcctccgtgtctggtctccgtggacagtcgcacntctctgcactggaaccngcagtgattgtagtaaacttctacttgtctctagtaaccaacactacaaccaaaataaccgacccctaaactcactactattatntaactcaccacgtaacggccgtcccgttaggttaacgggttactaacgtccgtcttcgtcccgtacggtctacgtaacgtcgtaacgggaccctaacccgcccggtccctaccctacgtaacctaactccgttcggtcgggtaccttaccggaggtacgtagggaacggaacggtaggtccttagtaacttactacgtcgtacttcggggtactatacgtagttcggaccgtaggttcttaactcttacgttagttccgttccggttaacggtaacggttacggtaaccgttacgggttaacccgtaccgttacggttacccggttacaacccgggtaaccaacccggtaacccaacccttacggttaacccttaaccgttaaccccg

SEQ ID NO: 417327 - DNA, 599 bp, Homo sapiens
  misc_feature: GZ8MTXP01D6WM6.19.78.H01.1.454.CMB.2.raw
  modified_base (263)..(263): a, c, t, g, unknown or other
  modified_base (301)..(301): a, c, t, g, unknown or other
  modified_base (427)..(427): a, c, t, g, unknown or other
  modified_base (469)..(469): a, c, t, g, unknown or other
  modified_base (477)..(477): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtcgtggtcctccgtggacagtcgtcaccatctcctgcactggaaccagcagtgatgtagaaacttctaactgtctctgtacanatcaaccaaataaacgaccccaaactcatctaattatnatcgaccataacggccgacccttcgtagggttttactaactcgtcttcgtccgtcgactacgaagtctacggacaaccgtaccggtccctaccctacgtactaacttcgtacgtcgggcttaccgnggtcctaggacgacggagtctgaacttacatcgcctgacctntaaatcgnggacgtacggttctaattcctagttatcgtcgtaacgtacggttaggaccttacggtactccgttacgttacgttaccgaacgaaccgaaccgaccctacccttacgtccgttaacgttccc

SEQ ID NO: 417328 - DNA, 695 bp, Homo sapiens
  misc_feature: GZ8MTXP01AUDVV.19.78.H01.1.454.CMB.2.raw
  modified_base (350)..(350): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtaaccaacataccaaaccaaaataaaccgacccccaaatcactactatttatgatcgaccacgtaacgccggtacctacgtagggtttactaattcgtacctttctctggacctacgaacgttcncggaccaaaccgccggtccctcctagaactaatccccgtcgtcgggacctaccggaggtccgtagaacgggacgacggtctagtacttacgtacgtcgtctaacgctacgtatatcggacgtacggttctacttccgttaccttaacggttccgttaacgggacggtacggggtaccgtaacgggtacctaccggttaccgtacggaccaaccgacccgtaccggaacccaaccccgtactctaaccgttcctcccgttaccgtttaccccaccccttaccaccgacccgtaaaggtaccgtaaccgttaagggaccgggttcgggtccgttaacgggaaccggg

SEQ ID NO: 417329 - DNA, 681 bp, Homo sapiens
  misc_feature: GZ8MTXP01ANOOG.19.78.H01.1.454.CMB.2.raw
  modified_base (224)..(224): a, c, t, g, unknown or other
  modified_base (305)..(305): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcgtcaccatctctgcactggaaccngcagtgtagttgttagaacttctaacttgtctctgtaccaacataccaaccaaagtaaccacccctaaatcatactattangatacgacaacgtaacggccgtacccgtcggtaacgggtttctaacgtccgtccttcgtccgttcggaccttaccgaacggttccgtaacgggaccctaacccgtccgggcccccttacccgtacgaacctaacgttcctacggtcgggaccttaccggaggcgtacgggaaggtacccggaggtctacggtaactttacgtaacgtcgtaaccgtcgtactagtacgtacgtacggtacgttacgttacgttacttccgttacgttacgttacgttaccggtaacggtaacgttcgggtaaaccttacggtaccgtaccgttcgttacgacccgaaccgacccgaaccgtacccaccttacgtccgttaactccg

SEQ ID NO: 417330 - DNA, 643 bp, Homo sapiens
  misc_feature: GZ8MTXP01A1W8Y.19.78.H01.1.454.CMB.2.raw
  modified_base (227)..(227): a, c, t, g, unknown or other
  modified_base (306)..(306): a, c, t, g, unknown or other
  modified_base (523)..(523): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggccccagtctgccctgactcagtctgcctccgtgtctgggtctccgtggacagtcggtcaccatctcctgcactggaaccngcagtgatgttagaaattctaacttgtctctgtacacatcaacccaaataacgccccaaactcatactatttatgatcnccaacgtaacgccgtaccctcgtagggtttctaacgtcgactttctcctggctaccgaagtcctagggaccaacgaccggtccctcccgtatactaacttcgtctcgggcctaccgaggccgtaggacggaccggaggtctacggtaattacgtaacgttgtccttgggtacttacgtaattacgtcgaccgttaacggttcgttactttcccgttnttttaacgtccggtttactaaccgggtacgttacgggtaacccgaaacggtccgtaaccgttccgttcgttccgaaccgaccccaacggtaccccaacccgttctaacgttccctaaccg

SEQ ID NO: 417331 - DNA, 641 bp, Homo sapiens
  misc_feature: GZ8MTXP01CYD2T.19.78.H01.1.454.CMB.2.raw
  modified_base (197)..(197): a, c, t, g, unknown or other
  modified_base (261)..(261): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacngtcggtcaccatctcctgcactggaaccagcagtgatgtagaaattctacttgtctctgacaanatcaccaaataaacgccccaaactcatctatttatgatcgccaataacgccgtccctgtaggggtttctaacttcgtctttctccgtcggtactcctaagtctaacgggccaacgacggtcctcctagacactctcgtcggctcgagtcgtaggacggacgaggtctagtaacttactactgtacgtcgggtctagtacttagtcgtcgtaggttccgtattccttacgtttaacttcggtttacgttaacgggtaacgttacggggtaaccgttaacggttaccggtacccgttacccggttacggttacccgtaaccggtacccccgtaaccgggaccccctaaaccccgttcggttaacccgttccgtttaaccccg

SEQ ID NO: 417332 - DNA, 768 bp, Homo sapiens
  misc_feature: GZ8MTXP01BKPRN.19.78.H01.1.454.CMB.2.raw
  modified_base (267)..(267): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcgtggacagtcgcacatctcctgcacgtggaaccagcagtgattggttagtaaattcctaacttgtctctgtaccaanatacaaccaaataaacgccccaaactcatactatttatagtatcgaccaacgtaacggccggtcccgtacgtacggggtttactaacgtcgtacttctcccgtcggtctaccgaacgtcgtacggaccctaaccgaccggtcccttacccgtcgtaacctaacgttccgttcgtcgggaccttaccgacggcgtacggaacgggaaccggtacgtcgttaagtaactttaacgttaacgttcggtaaccttcgggtactttacgaacgttaacgttcggaaccgttaccggggtttacgtttaacttacccgttttagtttaacggtttccggtttccggtttaaaccggggtaacggttaaccgggggttaaacccgttaaacggttccccgtaaaccgggttacccggttacgggttaacccgtaacccgggaccccgtaaaaccgggtacccccctaaaccccgttacgggtttaaccgttaaccctttaacccccgg

SEQ ID NO: 417333 - DNA, 667 bp, Homo sapiens
  misc_feature: GZ8MTXP01B94LC.19.78.H01.1.454.CMB.2.raw
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaattctaactgtctctgtacacatacaaccaaataacacccaaactcatacatttatgatcgaccaacgtaacggccggtacccttacgtacggggtttactaacgtcgtcttactccgtcggctacgaacgtcgtaacggacaaccgaccggtccctaccctagacctaactctccgtcggcctaccgaggtcgtaggaacggacggacggtctagtaacttacctacgtgtccgtcggtacttacctattacgtcgtaccgtagggttactttaacttcctttacgtttaacgttcggttacgttaaccgggtaaacgttcggggtaaaccttaaccgggtaccgtacccggttccgttacggttacccgaaccgaccccgtaaaccggccccctaaacccgacttccgttaaccctttaaccccg

SEQ ID NO: 417334 - DNA, 645 bp, Homo sapiens
  misc_feature: GZ8MTXP01B60NC.19.78.H01.1.454.CMB.2.raw
  modified_base (227)..(227): a, c, t, g, unknown or other
  modified_base (259)..(259): a, c, t, g, unknown or other
  modified_base (268)..(268): a, c, t, g, unknown or other
  modified_base (277)..(277): a, c, t, g, unknown or other
  modified_base (281)..(281): a, c, t, g, unknown or other
  modified_base (286)..(287): a, c, t, g, unknown or other
  modified_base (290)..(290): a, c, t, g, unknown or other
  modified_base (392)..(392): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcggtacaccatctctgcactgaaccngcagtgatgtagaattctacttgctctgacantacacaaanacacccaancatntatannatnacatacgcgtcctcgtaggttactagtctcttcgtcctcggctaccagtcctaagaccaaccgccggccctccctagactaactcgtgtcggtcctaccggnggtactggacggtaacggacgggttctacggttaacttacgtacgtagtccttgggtcttagtaacttacgtgtaccgtacggggtttccttaacttccgttctttacggttcgtttaccggttaaccggtaacggttacgggtacccgttaaacgggttacccgtacccgggtttaccgttccgggacctaacccgaaccccggtaaccgggtaaccccctacccgacggtttccttaaccccggttccccg

SEQ ID NO: 417335 - DNA, 682 bp, Homo sapiens
  misc_feature: GZ8MTXP01A6TMN.19.78.H01.1.454.CMB.2.raw
  modified_base (254)..(254): a, c, t, g, unknown or other
  modified_base (266)..(266): a, c, t, g, unknown or other
  modified_base (280)..(280): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacagtcggtcaccatctcctgcactggaaccagcagtgatgttagaaattctaactntctctgtacaanatcaaccaataacnccccaaatccatctattatgatcgaccactaacgcgaccctcgtacggggtttctaatccgtacttctccctacgggtctaccgaagtccgtaacggtaccaaccgtacccggtaccccttccctaggtaacctaaactccgtccgtttcgggggacccttaccggaacgggtccgttagggaacggtaacccgggtaagggtcccgtaggtaactttaactaaccgtaggtcgtcgtcgtacaagttacgtgtcgtacggttcgttaactcttccgtttaagtcgttcgttaacgggtaacgttacgggtacccgaaacggttccgtacccggttaccgttacgggttccaaccgggacccaaaccggtcccctaaaccccacgtcgttcccgttaacccg

SEQ ID NO: 417336 - DNA, 677 bp, Homo sapiens
  misc_feature: GZ8MTXP01BZHI4.19.78.H01.1.454.CMB.2.raw
  modified_base (251)..(251): a, c, t, g, unknown or other
  modified_base (457)..(457): a, c, t, g, unknown or other
tcagtactctcgtgcacgaccggtgctcgatttagtgtgagtagtttgggttgggggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcggtcaccatctcctgcactggaaccagcagtgatgtagaattctaacttntctctgtaccaacatacaaccaaataaacgaccccaaactcaatcaatttatagatgaccaactaacggccggtccctcgtacggggtttactaaactcgcttctcctcggactaccgtaaacgtcgtagggaccaaccgaccgggtaccctccctacgaacctaactccgtcgtcggtcctacgacgcgtaggaggacggacgtntacgtattacgtacgtgtctcggcttatacgttagtcgtaacgtcggttacgttaacttccttacgtttacgttcgttaccggttaacgggtaacggttaccgggtaaaccgttaccgggtacccgttaaccgttacccggttacggttacccgtaacccggaccccggtaaacccggtaacccccaacccttaaccggtccgttaacccgttaaccccg

SEQ ID NO: 417337 - DNA, 724 bp, Homo sapiens
  misc_feature: GZ8MTXP01CGOJU.19.78.H01.1.454.CMB.2.raw
  modified_base (198)..(198): a, c, t, g, unknown or other
  modified_base (206)..(206): a, c, t, g, unknown or other
  modified_base (229)..(229): a, c, t, g, unknown or other
  modified_base (297)..(297): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtcctgccctgactcagtctgcctcgtgtctggtctcctggacngtcgcacntctcctgcactgaaccagcagtnatgttagaattctaacttgtctctgtaccacatacaaccaaactaacgccccaaatcatactatttanagtactacgacctaacgtacggtccggcccgttacgtacgggggttttactaacgttccgtcttctccgtcggtctacctaacggtcgtaacggacctaaccgtaccggtccctcccgtagaacctaacgtcgtacgtcgggtacctccggaacgggtcgtggaacgggtaaccgtagggtccgtacgtaactttaccgtaacgttcgtaccgttcgggtcttataaacgttacggttacgaccgttaacgggttcctttaacgttccgttttaacgttacgttacggtttccggttaacccggtaaacggttaccggggtaaacccgttacgggttacccgtaacccggttcccggttaaggttcccgtaacccgaccccggttaaccgaccccgtaaccccacgttccgttccccgttaaccccg

SEQ ID NO: 417338 - DNA, 678 bp, Homo sapiens
  misc_feature: GZ8MTXP01CKCM8.19.78.H01.1.454.CMB.2.raw
  modified_base (197)..(197): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcacgtggaaccagcagtgatgtagaaattctaacttgtctcctgtaccaacatcaaccaaataaacgaccccaaactcatactatttatgatcgaccaacgtacgccggtcccgttcgtacgggtttactaacgtcgtcttctcccgtcggactaccgaagtcctaacgggaccctaaccgacccggtcccttcccgtacgaacctaacgttctccgtacggggtccttacccgacgggtccgtagggacgggtacggtaacgggtacttacgtaactttaccgtacgttcgccttcggggacttacctaagttactggtacccgtaagggttccgttatcttaccgtttattcggttacttaaccgggtaacgttcgggtaaaccttaaggggtcctaccggttcgttcgggttaccgaaccgacccgaaaccgtccccaaacccttctcggaaccgttcccg

SEQ ID NO: 417339 - DNA, 681 bp, Homo sapiens
  misc_feature: GZ8MTXP01CYUO8.19.78.H01.1.454.CMB.2.raw
  modified_base (274)..(274): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcgtcaccatctcctgcacgtaggaaccagcagtgagttagtagtaaattcctaacttgtctctacgtacacanacaaccaaataacgacccctaaatctaatctattatgatcgacctaactaacggtccgtaccctttacgtacgggggtttactaacgttccgtctttcgtccgtcggccttacgtaacgtcgtacggaccaaccgaccggccctccgtacgaactactcgtacgtcgggtacctccgaggtcgtacggaaggtaccggtaggtacgttacgtacttaacgtacgtaggtcctacgggtacttaacgtaagttaccgtggtacccgtagggtttactactttccgttacgtttagtttcgttacggttaacggtacggacgggttaaaccacggtccgtaaccgttccgttacggttaccgaaccgtaccaacggacccctaaccgttacttccgttccgttaacccg

SEQ ID NO: 417340 - DNA, 674 bp, Homo sapiens
  misc_feature: GZ8MTXP01DGR7Y.19.78.H01.1.454.CMB.2.raw
  modified_base (216)..(216): a, c, t, g, unknown or other
  modified_base (264)..(264): a, c, t, g, unknown or other
  modified_base (298)..(298): a, c, t, g, unknown or other
  modified_base (471)..(471): a, c, t, g, unknown or other
  modified_base (479)..(479): a, c, t, g, unknown or other
tcagtactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcgtcaccatctccngcatgaaccagcagtgatgttagaaattctaactgtctctgtacaacntcaccaaataaacgaccccaaatcatcgatttangatcgccaacgtaagcggtcctcgtaaggggtttctaatcgcttactcctggctcaagtctacgactaaccgaccgccctaccctacgaacaacgttctcccgtcggtcctaccgcggtacgtaggacggaacgacgtacgtggaaacttactaactcggtctcgggtcctanaacttagnggtacccttaaaggggttcccttaattccttagtttaaacgttcgttccgttaaccggtaaacgggttcggggtaaacccgttaaacgggttcccgtaacccggttaacccgtttacgggttaccgtaacccggaccccaaaccgggggtaccccctaaacccccggttataacccggttaaccgttaaaccccg

SEQ ID NO: 417341 - DNA, 510 bp, Homo sapiens
  misc_feature: GZ8MTXP02F9I2F.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctcctgctcaagtctggcacacggcctccctgacaatctctgggctcccaggctgaggacgaggctgattactactgctgctcatatgcaggtcgtatctcttatgtcttcggaactgggaccaaggtcaccgtctaggtcaagcccaagcccaacccgactcgtctacc

SEQ ID NO: 417342 - DNA, 530 bp, Homo sapiens
  misc_feature: GZ8MTXP02I37GP.19.78.H01.1.454.CMB.2.raw
  modified_base (260)..(260): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtacanatcaccaaataacgccccaaactcatcatttatgatgccactaagcggccctcaggggtttctaatcgcttctcctgctcaagtctggcacgacggcctcctgacaatctctgggctccaggctgagacgaggctgattactactgctgctcatatgcaggtctatcttcttatcgtcttacggaacttgggaccctaaagggtccaccggtacccttagggtaccaacggaccccaaacggaccccaaaacccccacgtacgtactacc

SEQ ID NO: 417343 - DNA, 524 bp, Homo sapiens
  misc_feature: GZ8MTXP02HG1Q4.19.78.H01.1.454.CMB.2.raw
  modified_base (362)..(362): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgcaactaagcggccctcaggggtttctaatcgcttctctggctccaagtctggcaacacggcctcctgacaatcctctggctccaggctgnggacgaggctgattactactgctgctcatatgcaggtcgtatctcttatgtcttcggaactgggaccaagggtcaccgtcctaggtcagcccaaggcccaacccactcgtcactctcgttcccgccctcctccaacgacgacgtacctgacgcgggctcggg

SEQ ID NO: 417344 - DNA, 515 bp, Homo sapiens
  misc_feature: GZ8MTXP02IOB70.19.78.H01.1.454.CMB.2.raw
  modified_base (196)..(196): a, c, t, g, unknown or other
  modified_base (431)..(431): a, c, t, g, unknown or other
  modified_base (444)..(444): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatctcctgcactggaaccagcagtgatgttgaaattctaaccttgtctctggtaccaacatcacccaaataaagcccccaaactcatcatttatgatgccactaagccggccctcaggggtttctaaatcgcttctcctggctccaagtctggcacacggcctccctgaccaatctctgggctcccaggctgaggacgaggctgattactactgctgctcattangcaggtctatctnttatgtcttacggaactgggaccaaaggtcaccgtctagtcaagcccaacggccaacccactcgtactacc

SEQ ID NO: 417345 - DNA, 531 bp, Homo sapiens
  misc_feature: GZ8MTXP02JR8TY.19.78.H01.1.454.CMB.2.raw
  modified_base (426)..(426): a, c, t, g, unknown or other
  modified_base (430)..(430): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaaactcatcatttatgatgaccactaagcggccctcaggggtttctaaatcgcttctcctgctccaagtctggcacacggcctccctgacaatctctgggctccaggctgagacgaggctgattactactgctgctanatangctagtctatcttacttatgtcttacggaacgtggaacctaaggtcctaccgtccgtaggtcaacgacccgaaacggaccccaaaccctacgtacgtacac

SEQ ID NO: 417346 - DNA, 514 bp, Homo sapiens
  misc_feature: GZ8MTXP02GY8SP.19.78.H01.1.454.CMB.2.raw
  modified_base (505)..(505): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcgaggggtttctaatcgcttctcctgctccaagtctggcacacgcctcctgacaatctctggctccaggctgaggacgaggctgattactactgctgctcatatgcaggtctatctcttatgtcttacggaacttgggacctaaggtccaccgtctaggtcaagccccaaggcccaaaccccntcgtctacc

SEQ ID NO: 417347 - DNA, 515 bp, Homo sapiens
  misc_feature: GZ8MTXP02JIST8.19.78.H01.1.454.CMB.2.raw
  modified_base (503)..(503): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaatcatcattatgatgccactaagcggccctcaggggtttctaatcgcttctctggctccaagtctggcacacggcctcctgacaatcctctgggctccaggctgaggacgaggctgattactactgctgctcatatgcaggtcgtatctcttatgtcttcggaactgggaccaaggtcaccgtcaggtcagcccaagccaacccactcgcactctcgttcccaccctcctccaacgacgacgtacngacgcggctcgg

SEQ ID NO: 417348 - DNA, 507 bp, Homo sapiens
  misc_feature: GZ8MTXP02JU2CU.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtactgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctcctggctccaagtctggcacacggcctccctgacaatctctgggctccagctgagacgaggctgattactactgctgctcatatgcaggtctatctcttatgtcttcggactgggaccaaggtcaccgtctagtcaagcccaaggcccaacccactcgactacc

SEQ ID NO: 417349 - DNA, 518 bp, Homo sapiens
  misc_feature: GZ8MTXP02GP35D.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcacccaaataaacgcccccaaactcatcatttatgatgccactaagcgccctgagggtttctaatcgcttctcctggctccaagtctggacacacgcctccctgaccaatctctgggctccgagctgaggacgaggctgattacactgctgctcatactgcaggtctatctcttatgtcttcggaactgggaacctaaggtcaccgtctaggtcaacgcccaaggcccaacccgactcgtactaccg

SEQ ID NO: 417350 - DNA, 510 bp, Homo sapiens
  misc_feature: GZ8MTXP02FULCT.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaagcccccaaactcatcatttatgatgccactaagcggccctcaggggtttctaatcgcttctcctgctcaagtctggcacacggcctccctgacaatctctgggctcccaggctgaggacgaggctgattactactgctgctcatatgcaggtcgtatctcttatgtcttcggaactggggaccaaggtcaccgtctaggtcaagcccaaggcccaacccactcgtctacc

SEQ ID NO: 417351 - DNA, 570 bp, Homo sapiens
  misc_feature: GZ8MTXP02JKGMW.19.78.H01.1.454.CMB.2.raw
  modified_base (372)..(372): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaatcatcatttatgatgccactaagcggccctcaggggtttctaatcgcttctcctggctccaagtctggcacatggccctccngacatctcgtggcctcgaggctggacggacgaggtctagtacttactacgtggtctcgtcctactatatcgacgtagggtcttatcttacttagtcgttaccgttacggaaccgttacgggaaccgtaaacggtccctacccggttccgtacggtaaccgacgacccgaacggacccctaaacccctacgtcgtaccc

SEQ ID NO: 417352 - DNA, 520 bp, Homo sapiens
  misc_feature: GZ8MTXP02GEU1H.19.78.H01.1.454.CMB.2.raw
  modified_base (293)..(293): a, c, t, g, unknown or other
  modified_base (354)..(354): a, c, t, g, unknown or other
  modified_base (361)..(361): a, c, t, g, unknown or other
  modified_base (508)..(508): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcacccaaataagcccccaaatcatcatttangatgccactaagcgccctcgtaggggtttctaatcgcttctcctgctccaagtctggcacncgctccngacaatctctggctccgagctgaggacgaggctagattacgtactgctgcttcatatgcaggtctatctcttatgtcttacggaactggggaacctaaacgggtctacccgtccttaacggcaacgcccgaaacggccccaaacccnctcgtctacccg

SEQ ID NO: 417353 - DNA, 512 bp, Homo sapiens
  misc_feature: GZ8MTXP02HBX4E.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatcacccaaataacgcccccaaactcatcatttatgatgccactaagcggccctcaggggtttcaatcgcttctctgctcagtctggcacacgcctcctgacatctctgggctccgagctgagacgaggctgattacactgctgctcatactgctaggtctatctcttatgttcttcggaacttggggaccctaaaggtccaccgtacctaggtcaagccccaaaggcccaaacccgctacgtcaccg

SEQ ID NO: 417354 - DNA, 503 bp, Homo sapiens
  misc_feature: GZ8MTXP02GQABM.19.78.H01.1.454.CMB.2.raw
  modified_base (378)..(378): a, c, t, g, unknown or other
  modified_base (418)..(418): a, c, t, g, unknown or other
  modified_base (495)..(495): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgtgcccagtctgccctgactcagtctgcctccgtgtctgggtctcctggacagtcggtcaccatctcctgcactggaaccagcagtgatgttgaaattctaacttgtctctggtaccaacatcacccaaataaacgcccccaaactcatcatttatgatgccactaagccggcctcaggggtttctaatcgcttcctctgctcaagtctgcaacacggcctcctgacaatctcnggctcaggctgagcgaggctgattacactgctgctcatangacagtcgtatctcttatcgtacttcggaacttgggaaccagtccaccgttcagtcacgtacccaggcccaaacccnctacgtcc

SEQ ID NO: 417355 - DNA, 518 bp, Homo sapiens
  misc_feature: GZ8MTXP02IVABB.19.78.H01.1.454.CMB.2.raw
  modified_base (443)..(443): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaatcatcatttatgatgccactaagcggccctcaggggtttctaatcgcttctctgctccaagtctggcacacggcctccctgacaatctctgggctccagctgagacgaggctgattactactgctgactcatatgcaggtcgtatctcttangttcttcggaacttggggacctaaaggtccaccgtcctaggtcaagtccccaaggcccaacccactcgtactacc

SEQ ID NO: 417356 - DNA, 521 bp, Homo sapiens
  misc_feature: GZ8MTXP02JYNIA.19.78.H01.1.454.CMB.2.raw
  modified_base (364)..(364): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagccccaaactcatcatttatgatgccactaagcggccctcaggggtttctaatcgcttctctggctccaagtctggcaacacggcctccctgacaatcctctgggctccaggctgnggacgaggctgattactactgctgctcatatgcaggtcgtatctcttatgtcttcggactgggacaaggtcaccgtcctaggtcacgcccaagccaaccccactacgtcactctcgttcccgccctcctccaacgacgacgtactgacgcggctcgg

SEQ ID NO: 417357 - DNA, 533 bp, Homo sapiens
  misc_feature: GZ8MTXP02IDLDP.19.78.H01.1.454.CMB.2.raw
  modified_base (229)..(229): a, c, t, g, unknown or other
  modified_base (354)..(354): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaanatcaccaaataacgccccaaatcatcattatgatgccactaagcggcctcaggggtttctaatcgcttctctggctccaagtctggcaacacgcctccctgacaatcctctggctccgaggctgnggacgagctgacttactactgctgctcatagtgcaggttcgtatcttcttatgttcgttcggaacgttggaacctaacggtcaccgtctaggtcacgacccaacggcccaaaacccactcgtccactcttccgttaccccaccctcctcccaacgacgacgtactaggacgcggctcgg

SEQ ID NO: 417358 - DNA, 566 bp, Homo sapiens
  misc_feature: GZ8MTXP02H5H5S.19.78.H01.1.454.CMB.2.raw
  modified_base (451)..(451): a, c, t, g, unknown or other
  modified_base (454)..(454): a, c, t, g, unknown or other
  modified_base (456)..(456): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctctggacagtcggtcaccatctcctgcactggaaccagcagtgatgttaggaaattctaaccttgtctcctgtaccaacataccaacccaaaataaacgcccccaaaactcaatcatttatgatgaccactaaagcggccctcgaggggtttctaaatcgcttctcctggctcaagtctggacacacggcctccctagaccaatcctctcgggctacccgaggcctggaaggacggaaggctagacttactactgctgcctanatngngagtactattcttattatcgttcgttacggaacgtacgggaacctaggtaccaccgtaccgtagaccaaccgacccgaaaccgaccccaaaccctacgtacgtacctacg

SEQ ID NO: 417359 - DNA, 509 bp, Homo sapiens
  misc_feature: GZ8MTXP02JY1SI.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctggtaccaacatcacccaaataaagcccccaaactcatcatttatgatgccactaagcggccctcaggggtttctaaatcgcttctcctggctccaagtctggcacacggcctccctgacaatctctgggctccaggctgagacgaggctgattactactgctgctcatatgcaggtcgtatctcttatgtcttcggaactggaccaaggtcaccgtcctaggtcaagcccaaggccaacccactcgtctacc

SEQ ID NO: 417360 - DNA, 515 bp, Homo sapiens
  misc_feature: GZ8MTXP02I6FNO.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggcccctcaggggttttctaaatcgcttctcctgctcaagtctggcacacgcctcctgacaatctctgggctccagctgaggacgaggctgattacactgctgctcatatgcagtcgtatctctttatgtcttcggaactgggacctaaaggtccaccgtcctaggtcaagccccgaaggcccaacccgactcgtactac

SEQ ID NO: 417361 - DNA, 568 bp, Homo sapiens
  misc_feature: GZ8MTXP02HBAVA.19.78.H01.1.454.CMB.2.raw
  modified_base (305)..(306): a, c, t, g, unknown or other
  modified_base (308)..(309): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaaataaacgcccccaaaatcaatcatttannannacacagcgcctcgtaggttactaatctctctcctgctacactctcgacacacgcctcctacacaactactctcgctccgacgcgtagaggacggacggacgtagtacttactactacgtcgtcgtctactatatagacgtacggtacgttacttcttacttacttacgttcgttacggtaacgtacggtaacgaacggtaccgtaccgtaccgtacgtacgaacgaccgaaaccgacccgaacccaacctacgtactac

SEQ ID NO: 417362 - DNA, 530 bp, Homo sapiens
  misc_feature: GZ8MTXP02H9FQK.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaaagcggccctcaggggtttctaatcgcttctcctgctccaagtctggcacacggcctccctgacaatctctgggctccaggctgagacgaggctgattacactgctgctcatatgcaggtcgtatctatcattcgttcgttacggacgtcggaaccgaaacggtccaaccgttcgtacggtcgaccgacccgacggaccccaaccctacgtctaccc

SEQ ID NO: 417363 - DNA, 513 bp, Homo sapiens
  misc_feature: GZ8MTXP02F1CXJ.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataaagcccccaaactcatcatttatgatgccactaagcggccctcaggggtttctaatcgcttctcctggctccaagtctggcacacggcctccctgacaatctctgggctccaggctgaggacgaggctgattactactgcctgctcatatgcagggtctatctcttatgtcttcggaacttgggaccaaggtcaccgtctagtcaacgcccaaggcccaacccactcgtactacc

SEQ ID NO: 417364 - DNA, 514 bp, Homo sapiens
  misc_feature: GZ8MTXP02I46KX.19.78.H01.1.454.CMB.2.raw
  modified_base (360)..(360): a, c, t, g, unknown or other
  modified_base (374)..(374): a, c, t, g, unknown or other
  modified_base (417)..(417): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaacgcccccaaactcatcatttatgatgccactaagcggccctcagggtttctaatcgcttctcctgctcagtctggcacncgctcctgacatcnctggctcagctgagacgaggctagattactactgaccttgctnatatgcgaggtctatctcttatgtcttacggacgttggacctaaggtccaacgtcctaggtcaacgtcccgaacggcccaaacccgctcgtcctacc

SEQ ID NO: 417365 - DNA, 510 bp, Homo sapiens
  misc_feature: GZ8MTXP02IPWDU.19.78.H01.1.454.CMB.2.raw
  modified_base (423)..(423): a, c, t, g, unknown or other
  modified_base (441)..(441): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataaacgcccccaaactcatcatttatgatgaccactaagcggccctcgagggtttctaatcgcttctcctgctccaagtctggcacacgccctccctgaaccaatctctgggctccaggctggaggacgaggctagattacatgctgcttnatatgcagttcgtatctntatgtcttcggactggacctaaggtcaccgtctaggcaacgacccgaacgcccaacctctcgtactacc

SEQ ID NO: 417366 - DNA, 499 bp, Homo sapiens
  misc_feature: GZ8MTXP02GA7XU.19.78.H01.1.454.CMB.2.raw
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcggtcaccatctcctgcactggaaccagcagtgatgttggaaattctaactgtctctggtaccaacatcacccaaataaacgcccccaaaactcaatcatttatgatgccactaagcgccctcaggggtttctaaatcgcttctcctgctcaagtctggcacacggcctcctgacaatctctgggctccgagctgaggacgaggctgattactactgctgctcatatgacaggtctatctctatgtcttcggaactggaccaaggtcaccgtcaggtcaagcccaaggccaacccatcgtcacc

SEQ ID NO: 417367 - DNA, 558 bp, Homo sapiens
  misc_feature: GZ8MTXP02IH38E.19.78.H01.1.454.CMB.2.raw
  modified_base (421)..(421): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtacacatcaccaaataaagcccccaaatcatcatttatgatgccactaaagcggccctcaggggtttctaaatcgcttctcctggctccaagtctggcacacgcctccctgaccaatctctgggctccagctagagacgaggctgattactactgctgccttanatatgcgtagtcgttattcttactttagtcgttaccgttacggtaaacgtcgggaacctaaacggtaccgtaccgttaccgtaaggtccgaaccgacccgaaacggaccccaaaaccccgtacgtacgtacctaccg

SEQ ID NO: 417368 - DNA, 636 bp, Homo sapiens
  misc_feature: GZ8MTXP02HTITV.19.78.H01.1.454.CMB.2.raw
  modified_base (274)..(274): a, c, t, g, unknown or other
  modified_base (450)..(450): a, c, t, g, unknown or other
  modified_base (455)..(455): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctctgcactggaaccagcagtgatgttagaaattctaacttgtctctgtacacatcaccaaataacnccccaaatcatcatttatgatgaccactaacgccggtccctcgtagggtttctaatccgtcttctcctggtcctacaacgtctacggacaccgaccggccctcctacgacaactctcgtcgggcctcccgaggcgtaggacggacgaggtctagacttacactgtctgtaccttanattancgtacgtacgggttcttaacttcgttacctttaagtcgttacggttaccggtaaacggtttaccgggaaaccgtaaacgggttacccgtacccggttaccgttaaacgggtccaaaccggtacccccgaaaaccgggttacccccaaaaccccttaccggtccgttaacccgtttaccccg

SEQ ID NO: 417369 - DNA, 522 bp, Homo sapiens
  misc_feature: GZ8MTXP02HGRO6.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacctgtctcctgtaccaacatcaccaaataaagccccaaactcatcatttatgatgccactaagcggccctcaggggtttctaatcgcttctcctgctccaagtctggcacaccggcctccctgacaatctctgggctccaggctggaaggacgaggctgattacgtactgctgcttcatatgcaggtcgtatcttcgttatgtctttcggaaacgttggaccaaaggtcaccgtacctaggtcaacgccccaaggcccaacccactcgtacaccg

SEQ ID NO: 417370 - DNA, 534 bp, Homo sapiens
  misc_feature: GZ8MTXP02GW31A.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcacccaaataaagcccccaaactcatcatttatgatgccactaagcgccctcaggggtttctaatcgcttctcctgctcaagtctggcacaccggcctccctgacaatctctgggctccgagctgagacgagctgattacactgctgcttcatatgactagggtctattcttctttagtcgttcttacggaacgttgggaacccgtaaggtaccaccgttccgtaggttcaacgaccccaaacggcccaaaccccactcgtactacccg

SEQ ID NO: 417371 - DNA, 524 bp, Homo sapiens
  misc_feature: GZ8MTXP02HRYC0.19.78.H01.1.454.CMB.2.raw
  modified_base (299)..(299): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcaccaaataaacgcccccaaactcatcatttangatgccactaagcgccctcagggtttcaatcgcttctcctgctcaagtctcggcacacgcctccctgacaatctcgtggctccgagctggagacgaggctgattactactgctgcttacatatgcagggtctatcttcttatgtctttcggaaacttggggaaccaagggttccaaccggtcctaaggtcaacggacccaaacggcccaaacccgctcgtacacc

SEQ ID NO: 417372 - DNA, 503 bp, Homo sapiens
  misc_feature: GZ8MTXP02IKS14.19.78.H01.1.454.CMB.2.raw
  modified_base (492)..(492): a, c, t, g, unknown or other
tcagtactctcgtgcacgaccggtgctcgatttagtgtgagtagtttgggtttgggggtcacaaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagcccccaaatcatcatttatgatgccactaagcggccctcagggtttcaatcgcttctctgctcaagtctggcacacgcctccctgaccaatctctggctccaggctgaagacgaggctgattactactgctgcttcatatgcaggtcgtatctcttatgtcttcggaacttgggaccaaaggtcaccgtctaggcaagcccaacggcccaacccnctacgtctacc

SEQ ID NO: 417373 - DNA, 509 bp, Homo sapiens
  misc_feature: GZ8MTXP02IXRVG.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaagcccccaaactcatcatttatgatgccactaagcggccctcaggggtttctaatcgcttctctgctcaagtctggcacacggcctccctgacaatctctgggctccaggctgaggacgaggctgattacactgctgcttcatactgcaggtcgtatctcttatgtcttcggatgggaccaaggtcaccgtctaggtcaagcccaacggcccaaacccactcgtactacc

SEQ ID NO: 417374 - DNA, 508 bp, Homo sapiens
  misc_feature: GZ8MTXP02GOV2Z.19.78.H01.1.454.CMB.2.raw
  modified_base (436)..(436): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtaccaacatcaccaaataaagccccaaactcatcatttatgatgccactaagcggccctcaggggtttctaatcgcttctcctggctcaagtctggcacacggcctccctgacaatctctgggctccaggctggaggacgaggctgattacactgctgctcatatgcaggtcgtatctnttatgttctacggactggacctaaggtcaccgtctaggtcaacgcccgaacggcccaacccactcgactacc

SEQ ID NO: 417375 - DNA, 512 bp, Homo sapiens
  misc_feature: GZ8MTXP02GZ1WE.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctcctggtaccaacatcacccaaataaacgcccccaaactcatcatttatgatgccactaagcgccctcagggtttctaatcgcttctctgctcaagtctggcacacggcctccctgacaatctctgggctcccgaggctgaggacgaggctgaacttacacttgctgcttcatatgcaggtctatctcttatgtcttcggaactggaacaaggtcaccgtcctagtccaacgcccgaaagcccaacccgactcgtctacc

SEQ ID NO: 417376 - DNA, 505 bp, Homo sapiens
  misc_feature: GZ8MTXP02JLI10.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaactgtctctgtacaacatcaccaaataacgccccaaactcatcatttatgatgcactaagcggccctcgagggtttctaatcgcttctcctgctcagtctggcacacggcctcctgacaatctctcgggctcccgagctgaggacgaggctagattactactgctgactcatatgcaggtctatctcttatgtctcggaactgggaccaaggtcaccgtcctaggtcaacgcccaaacggccaacccactcgtctacc

SEQ ID NO: 417377 - DNA, 572 bp, Homo sapiens
  misc_feature: GZ8MTXP02H0MYQ.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctctgcactggaaccagcagtgatgttagaaattctaacttgtctctggtaccaacatcaccaaataaacgcccccaaactcatcatttatgatgacactaagcgccctctagggtttctaatcgcttctcctgctcaagtctggcacacgcctccctgacaatctctggctcagctggagacgaggctagattacactgctgctcattatcgctaggtcgttatcttactttagtcgttcgttacgggaacgttacgggggaaccctaaacggggttaccctaccgggttacccttaaggggttcccaacggtacccccgaaaccgggacccccaaaacccccgacttccggttaacctcccg

SEQ ID NO: 417378 - DNA, 619 bp, Homo sapiens
  misc_feature: GZ8MTXP02HJTL9.19.78.H01.1.454.CMB.2.raw
  modified_base (355)..(355): a, c, t, g, unknown or other
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctcctggtaccaacataccaacccaaataaacgacccccaaactcatacatttatgatcgaccaactaaacgccggccctcgtaggggtttctaaatcgcttcncctgcctcaagtctggcacacggcctccctagactaatctcgtggcctccgagctaggagacgaggctagattactacngtctgcttacatagtgacgtaggtactacttcttaccttaagtcgttaccgtttacgggaaacgttacgggggaaacctaaacggggttaccctaacccggttacccgttaaggggtacccaaccggacccccgaaaacggggaccccccaaaaacccccgtctaccggtttaccctaaaccccg

SEQ ID NO: 417379 - DNA, 507 bp, Homo sapiens
  misc_feature: GZ8MTXP02HGNN9.19.78.H01.1.454.CMB.2.raw
  modified_base (266)..(266): a, c, t, g, unknown or other
  modified_base (285)..(285): a, c, t, g, unknown or other
  modified_base (497)..(497): a, c, t, g, unknown or other
  modified_base (505)..(505): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaaccaaataaacgccccaaatcatcattangatgccactaagcgccctnagggttcaatcgcttctctgctcaagtctggacaacacggcctcctgacaatcctcgtggctcgaggctggacgacgagctagattacactgctgctcatatgcgagtcgtatctcttatgtcttacgacgtggacaaggtcacgtcaggtcacgccaacgcccaacccacgtctcactctcttcccaccctccaccgaacgacgactacgngacgcgcncg

SEQ ID NO: 417380 - DNA, 534 bp, Homo sapiens
  misc_feature: GZ8MTXP02G9FPS.19.78.H01.1.454.CMB.2.raw
  modified_base (279)..(279): a, c, t, g, unknown or other
  modified_base (434)..(434): a, c, t, g, unknown or other
  modified_base (522)..(522): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtacaacatcaccaaataacnccccaaactcatcatttatgatgccactaagcgccctgtagggtttctaatcgcttctcctggctccaagtctggacaccgacggccctacctgacctaatctcgtcgggctccgaggctggaggacgagctagacttacgactgctgctcatangctaggtctatctcttatcgtacgttacggaaactgggaaccctaaggtccaccgtctacggtcaacgacccgaacggcccaaacccncgtacgtcctac

SEQ ID NO: 417381 - DNA, 512 bp, Homo sapiens
  misc_feature: GZ8MTXP02GADHS.19.78.H01.1.454.CMB.2.raw
  modified_base (476)..(476): a, c, t, g, unknown or other
  modified_base (485)..(485): a, c, t, g, unknown or other
tcagtactctcgtgcacgaccggtgctcgatttagtgtgagtagtttgggtttggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctactgtctctggtaccacatcacccaaataaagcccccaaactcatcatttatgatgccactaagcggcccctcaggggtttctaatcgcttctcctggctccaagtctggcaccacggccctcctgacaatctctggggctccagctgaggacgaggctgattactacgtgctgcttcattatgcgaggttcgttatctcttatgtcttcggactgggacagtctaccncctgaccgngacccaggaccccaccactcgtctacc

SEQ ID NO: 417382 - DNA, 507 bp, Homo sapiens
  misc_feature: GZ8MTXP02HLK3E.19.78.H01.1.454.CMB.2.raw
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcacccaaataaagccccaaatcatcattatgatgccactaagcgccctcagggttctaatcgcttctctggctcaagtctggcaacacgcctcctgacaatcctctggctccagctgaggacgaggctgattactactgctgctcatatgcaggtcgtatctcttatgtcttcgacttgggaccaggtcaccgtctaggtcagcccaaggccaacccactcgcactctcgttcccaccctcctccaacgacgacgtactacgacgcggctcgg

SEQ ID NO: 417383 - DNA, 522 bp, Homo sapiens
  misc_feature: GZ8MTXP02IMPKU.19.78.H01.1.454.CMB.2.raw
  modified_base (513)..(513): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgacccccaaactcaatcatttatgatgccaactaagcggccctcgaggggtttctaaatcgtcttctcctggctccaagtctggcacacgcctccctgacaatctctgggcctccgaggctgagacgaggctgattacactgctgcttcatatgacaggtcgtatctcttatgtcttcggaactgggaccaaggtcaccgtcctaggtcaagcccaaagcccaaacccnctcgtcacc

SEQ ID NO: 417384 - DNA, 547 bp, Homo sapiens
  misc_feature: GZ8MTXP02IO386.19.78.H01.1.454.CMB.2.raw
  modified_base (416)..(416): a, c, t, g, unknown or other
  modified_base (420)..(420): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaactgtctctgtacaacatcaccaaataacgacccccaaatcatctatttatgatcgaccactaagccgtccctcgtagggtttctaatcgcttctctgctcatctgacacacgcctcctagacatctctcggctccgaggctggacggacgaggtctagtattacactgctnctanatatgcgtaggtctatcttcttatcgttacttacgggaacgttcgggaacctaaagggtccctaaccggttccgtagggtaccaacggaccccaaacggccccaaaacccgtactacgtcctacccg

SEQ ID NO: 417385 - DNA, 523 bp, Homo sapiens
  misc_feature: GZ8MTXP02I4YBP.19.78.H01.1.454.CMB.2.raw
  modified_base (422)..(422): a, c, t, g, unknown or other
  modified_base (443)..(443): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccacatcacccaaataaagcccccaaactcatcatttatgatgccactaagccggccctcaggggtttctaatcgcttctctgctcaagtctggcacacggcctccctgaccaatctctgggctccaggctgagacgaggctgattacactgctgcctnatatgcaggtctatctcttangttcttacggacttgggacctaaagggtcaccgtcctaggtaccaacggccccaaaggccccaacccactcgtactaccg

SEQ ID NO: 417386 - DNA, 506 bp, Homo sapiens
  misc_feature: GZ8MTXP02F6UHM.19.78.H01.1.454.CMB.2.raw
  modified_base (261)..(261): a, c, t, g, unknown or other
  modified_base (395)..(395): a, c, t, g, unknown or other
  modified_base (409)..(409): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccaanatcaccaaataacgaccccaaatcatcatttatgatgccactaacgccggccctcgaggggtttctaaatcgtcttctcctgctcaagtctggcacgacgcctcctgacaatctctggctccgagctgagacgngctgatacactgcngctacgatactgcaggtctatctcttagtgtcgttacgactcggaccaggtccaccgtcaggtcaacgacccaacgcccaacccactcgtactaccg

SEQ ID NO: 417387 - DNA, 526 bp, Homo sapiens
  misc_feature: GZ8MTXP02JYR77.19.78.H01.1.454.CMB.2.raw
  modified_base (444)..(444): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggcctcctggacagtcggtcaccatctcctgcactggaaccagcagtgatgttggaaattctaacttgtctcctggtaccaacatcacccaaataaagcccccaaactcatcatttatgatgccactaagcggccctcaggggtttctaaatcgcttctcctggctccaagtctggcacacggcctccctgacaatctctgggctccaggctgaggacgaggctgattactactgctgctcatatgcaggtcgtatccttnttatgtcgttacggacgtcgggaactaacggtccaccgtcgtacgtacaacgacccgaacgacccaacccactacgtacacg

SEQ ID NO: 417388 - DNA, 496 bp, Homo sapiens
  misc_feature: GZ8MTXP02JGC7B.19.78.H01.1.454.CMB.2.raw
  modified_base (360)..(360): a, c, t, g, unknown or other
  modified_base (492)..(492): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaatcatcatttatgatgccactaagcggccctcaggggtttctaatcgcttctctgctccaagtctggcacntggcctacctgacaatctctgggcctccgaggctgaggacgaggctgattactactgactgctcatatgcaggtctatctacttatgtcttcggactggacaggtcacgtcagcacgcccaagccaaccctntcgc

SEQ ID NO: 417389 - DNA, 503 bp, Homo sapiens
  misc_feature: GZ8MTXP02H0GUD.19.78.H01.1.454.CMB.2.raw
  modified_base (357)..(357): a, c, t, g, unknown or other
  modified_base (366)..(366): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctgtaccaacatcaccaaataaacgcccccaaactcatcatttatgatgccactaagcgccctcgtagggtttctaatcgcttctctgctcaagtctgcacncgcctcccngacatctctggctccgagctggagacgagctgattacactgctgctcatatgctaggtctatctcttatgtcttcggaacttggaccaaggtccaccgtactacgtcaacgccaaacggcccaacccatcgtactcc

SEQ ID NO: 417390 - DNA, 517 bp, Homo sapiens
  misc_feature: GZ8MTXP02HK549.19.78.H01.1.454.CMB.2.raw
  modified_base (428)..(428): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgaccactaagcggccctcgaggggtttctaatcgcttctctgctcaagtctggcacgacggcctcctgacaatctctgggctccgagctggagacgaggctgattactactgctgctcatangcaggtctatctcttatgtcgttacggacgtgggacctaaggtccaccgtctaggtcaacgcccgaacggcccaacccactcgtctacc

SEQ ID NO: 417391 - DNA, 522 bp, Homo sapiens
  misc_feature: GZ8MTXP02FMHLZ.19.78.H01.1.454.CMB.2.raw
  modified_base (303)..(303): a, c, t, g, unknown or other
  modified_base (365)..(365): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtcccctggacagtcggtcaccatctcctgcactggaaccagcagtgatgttggaaattctaaccttgtctcctggtaccaacatcacccaaataaacgcccccaaactcatcatttangatgccactaagcggccctcaggggtttctaatcgcttctctcggctccaagtctggcaacncggcctcctgacaatctctgggctccaggctgaggacgaggctgattacactgctgctcatatgcaggtcgtatcttcttatgtcttacggacgttgggacctaaggtccaccgtcctaggtccacgcccgaacggcccaacccactcgtcacttcc

SEQ ID NO: 417392 - DNA, 505 bp, Homo sapiens
  misc_feature: GZ8MTXP02F89XS.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccaacatcacccaaataaagcccccaaactcatcatttatgatgccactaagcggccctcaggggtttctaatcgcttctcctggctcaagtctggcacacggcctccctgacaatctctgggctcccaggctgaggacgaggctgattacactgctgctcatatgcaggtctatctcttatgtcttcggaactgggaccaaaggtcaccgtctaggtcaagcccaaggcccaacccactcgtactacc

SEQ ID NO: 417393 - DNA, 506 bp, Homo sapiens
  misc_feature: GZ8MTXP02HCQB8.19.78.H01.1.454.CMB.2.raw
  modified_base (361)..(361): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaacgcccccaaactcatcatttatgatgccactaagcggccctcaggggtttctaatcgcttctcctgctcaagtctggcacncgcctcctgacaatctctggctccagctgagacgaggctgattactactgctgctcatatgcaggtctatctcttatgtcttacggaactgggaccaaggtcaccgtctaggtcaagcccaaggcccaacccgactcgtactacc

SEQ ID NO: 417394 - DNA, 529 bp, Homo sapiens
  misc_feature: GZ8MTXP02FN1NI.19.78.H01.1.454.CMB.2.raw
  modified_base (441)..(441): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtaggaaattctaacttgtctctggtaccaacatcaacccaaataaacgacccccaaactcatctatttatgatgccaactaacgccggccctcgaggggtttctaaatcgtcttctcctgctacaagtctcggcacaccggccctccctgacaatctctgggctcccgagctggaaggacgaggctagtattactacgtgctgcctnatatgcgaggtctatctcttatgtctacggactgggaccaaggtcaccgtctaggtcaacgaccaacggcccaacccactcgactacc

SEQ ID NO: 417395 - DNA, 513 bp, Homo sapiens
  misc_feature: GZ8MTXP02H47LO.19.78.H01.1.454.CMB.2.raw
  modified_base (363)..(363): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcacccaaataaacgcccccaaactcatcatttatgatgccactaagcggccctcgaggggtttctaatcgcttctctggctcaagtctggcacncggcctccctgacatctctggctccgaggctgagacgagctagaacttctactgctgctcatatgcaggtcttatctcttatgtcttacggaacttgggaccaaaggtcaccgtctaggtcaacgcccaagcccaacccactgtactacg

SEQ ID NO: 417396 - DNA, 538 bp, Homo sapiens
  misc_feature: GZ8MTXP02HVMLO.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatacaccaaataacgcccccaaactcatcatttatgatgaccataagcgccctgagggtttcaatcgcttctctgctcaagtctcgacacacgcctcctgacaatctctggctccgagctggagacgaggctagattacactgtctgtctacattatcgacgtaggtctattcttacttatcgttacgtttacggaacgttacgggaacctaagggttaccaccggtacctaggtcaacgtcccaacggacccaaacccgtactcgtacctacc

SEQ ID NO: 417397 - DNA, 558 bp, Homo sapiens
  misc_feature: GZ8MTXP02JGA58.19.78.H01.1.454.CMB.2.raw
  modified_base (397)..(397): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaagcccccaaatcatcatttatgatgccactaagcgccctcaggggtttctaatcgcttctctgctacagtctgacacgcgcctcctagacaatctcgtcggcctcgagctagaggacgngctagtattaactctgtctgctacatatgacgtaggttactattcttactttagtcgttacgttacggaacgttcgggaaacctaaacggttcccgaccgttaccgttacggaccgaaccgacccgaaacggacccccaacccgtactccgtactaacccg

SEQ ID NO: 417398 - DNA, 537 bp, Homo sapiens
  misc_feature: GZ8MTXP02HSQEZ.19.78.H01.1.454.CMB.2.raw
  modified_base (289)..(289): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctctgcactggaaccagcagtgatgtagaattctactgtctctgtacacatcaccaaataacgaccccaaactcatcatttangatgccactaagcgccctacgtaggggtttctaatcgcttctcctggctccaagtctcggcacgacgccctcctcgacaactctctgggctccgagcgtgaggacgaggctgattacgactgctgcttcatatcgcgtaggtcgtattcttctttagtcgttacgttacggtacgttacgggaccaacggtccgtaccgtccgtacgtcgaacgacccgaacggacccaaccccacgtactcctaccc

SEQ ID NO: 417399 - DNA, 518 bp, Homo sapiens
  misc_feature: GZ8MTXP02JR9Y1.19.78.H01.1.454.CMB.2.raw
tcagtactctcgtgcacgaccggtgctcgatttagtgtgagtagtttgggtttgggggtcacaagaggcagcgctctcgggacgtctccaccatagcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcgccctcaggggtttctaaatcgcttctcctgctccaagtctggcacacggctccctgacaatctctggctccgaggctgaggacgaggctgattactatgctgctcatatgcaggtctatctcttatcgtcgttcggaacttggggacctaagggtcaccgtcctaggtcaagaccccaaggcccaaccctactcgtctacc

SEQ ID NO: 417400 - DNA, 505 bp, Homo sapiens
  misc_feature: GZ8MTXP02J1CEK.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaagcccccaaactcatcatttatgatgccactaagcggccctcaggggtttctaatcgcttctcctggctccaagtctggcacacggcctccctgacaatctctgggctccaggctgaggacgaggctgattactactgctgctcatatgcaggtcgtatctcttatgtcttcgaactggaccaagtcaccgtctaggtcaagccaacggccaacccactcgtcac

SEQ ID NO: 417401 - DNA, 533 bp, Homo sapiens
  misc_feature: GZ8MTXP02ITI4X.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccacatcaccaaataaacgcccccaaactcatcatttatgatgccactaagcggccctcgaggggtttctaatcgcttctcctggctccaagtctggcacacggcctccctgaccaatctctcgggctccaggctgaggacgaggctgattactactgcttgctcatatgcaggtctatctcttatgttcttacggaacttcggggacctaaagggtccaccgtccgtaggttcaagaccccaaaggacccaaacccactcgtacctaccg

SEQ ID NO: 417402 - DNA, 507 bp, Homo sapiens
  misc_feature: GZ8MTXP02FOYSK.19.78.H01.1.454.CMB.2.raw
  modified_base (395)..(395): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcaccaaataaagccccaaactcatcatttatgatgccactaagcggccctcaggggtttctaatcgcttctcctggctcaagtctggcacacggcctccctgacaatctctgggctcccaggctgaggacgnggctgattactactgctgctcatatgcagtcgtatctcttatgtcttcggaactgggaccaaaggttcaccgtcctaggtcaagcccaaggcccaaccccgactcgtctacc

SEQ ID NO: 417403 - DNA, 502 bp, Homo sapiens
  misc_feature: GZ8MTXP02GGQMJ.19.78.H01.1.454.CMB.2.raw
  modified_base (494)..(494): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctggtaccaacatcacccaaataaagcccccaaactcatcatttatgatgccactaagcggccctcaggggtttctaatcgcttctcctgctccaagtctggcacacggcctcctgacaatctctgggctccagctgaggacgaggctgattactactgctgctcatatgcaggtctatctcttatgtcttacggacttgggaccaaggtcaccgtcaggtcaagcccaagcccaacccnctcgctac

SEQ ID NO: 417404 - DNA, 523 bp, Homo sapiens
  misc_feature: GZ8MTXP02F2QFF.19.78.H01.1.454.CMB.2.raw
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaaatcgcttctcctggctcaagtctggcacacggcctccctgacaaatctctgggctcccaggctgaggacgaggctgattacactgctgctcatatgccagggtctatctcttatgtcttcggaacttgggaccctaaaggtcaccgtcctaggtccaagccccaaaggcccaaaccccgactcgtctacc

SEQ ID NO: 417405 - DNA, 516 bp, Homo sapiens
  misc_feature: GZ8MTXP02IVL0F.19.78.H01.1.454.CMB.2.raw
  modified_base (262)..(262): a, c, t, g, unknown or other
  modified_base (365)..(365): a, c, t, g, unknown or other
  modified_base (374)..(374): a, c, t, g, unknown or other
  modified_base (416)..(416): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaanatcaccaaataacgcccccaaactcatcatttatgatgaccactaagcgccctcgagggtttctaatcgcttctcctgctcaagtctaggcacacgcctcccngacatctcnggctccagctgaggacgaggctgattactactgctgctcatntgctaggtctatcttcttatcgtcttacggaactggggaaccaaggttccaccgtactacgtcaacgacccgaaacggccccaaaccgctacgtcctacc

SEQ ID NO: 417406 - DNA, 497 bp, Homo sapiens
  misc_feature: GZ8MTXP02FV5SL.19.78.H01.1.454.CMB.2.raw
  modified_base (468)..(468): a, c, t, g, unknown or other
  modified_base (489)..(489): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcacccaaataaagcccccaaaactcatcatttatgatgccactaagcggcccctcaggggttttctaatcgcttctcctgctcaagtctggcacacggcctcctgacaatctctgggctcccaggctgaggacgaggctgattacactgctgctcatatgcaggtctatctcttatgtcttcggactgggaccaaggtcaccgtcngtcaagccacgaccacccacncgtctacc

SEQ ID NO: 417407 - DNA, 505 bp, Homo sapiens
  misc_feature: GZ8MTXP02HZBK8.19.78.H01.1.454.CMB.2.raw
  modified_base (319)..(319): a, c, t, g, unknown or other
  modified_base (358)..(358): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctggtacaacatcaccaaataaagcccccaaactcatcatttatgatgccactaagcggccctnagggtttctaatcgcttctcctgctccaagtctggcacncgcctcctgacatctctggctccgagctgagacgaggctgattacactgctgctacatatgcagtcgtatcttcttatgtcttacgacgttgggacctaaaggtccaccgtctaggtcaagcccaaggcccaacccatcgtactacc

SEQ ID NO: 417408 - DNA, 514 bp, Homo sapiens
  misc_feature: GZ8MTXP02IWYTY.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaagcccccaaactcatcatttatgatgccactaagcggccctcaggggtttctaatcgcttctcctggctccaatctggcacacggcctccctgacaatctctgggctcccagctgaggacgaggctgattactactgctgctcatatgctagggtctatcttcttatgtctttcggaactgggaccaaggtcaccgtctaggtcaagcccaacggcccaacccactcgctacc

SEQ ID NO: 417409 - DNA, 530 bp, Homo sapiens
  misc_feature: GZ8MTXP02G31YC.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataagcccccaaatcatcatttatgatgccactaagcggccctcgaggggtttctaaatcgcttctcctgctccaagtctggcacacggcctccctgacaatctctcgggctcccgaggctggaggacgaggctagacttactactgcctgcttcattactgctaggtctatctacttatgtcttcggaacttgggacctaaggtccaccgtctaggtcaacgtcccaaacggcccaaaccccgactcgtctacc

SEQ ID NO: 417410 - DNA, 544 bp, Homo sapiens
  misc_feature: GZ8MTXP02GWIFP.19.78.H01.1.454.CMB.2.raw
  modified_base (360)..(360): a, c, t, g, unknown or other
  modified_base (429)..(429): a, c, t, g, unknown or other
  modified_base (454)..(454): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataacgccccaaatcatcatttatgatgccactaagcggccctcgagggtttctaatcgcttctcctgctccaagtctggacacnccggcctccctgaccaatctctggggctccgaggctggaggtacgaggctagattacactgcctgctanattatgctaggtctatctctttagngttccgttacggaaacgttgggaaccctaagggttccaaccggtctacggtacaacggacccaaggaccccaacccgactcgactacccg

SEQ ID NO: 417411 - DNA, 517 bp, Homo sapiens
  misc_feature: GZ8MTXP02GCG7X.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcacccaaataaacgacccccaaactcatcatttatgatgccactaagcgccctcaggggtttctaatcgcttctcctgctcaagtctggcacacgcctccctgacaatctctgggctcccaggctggagacgaggctagattactactgctgctcatatgctaggtcgtatctcttatcgtcttacggactgggaccaaaggtcaccgtctaggtacaacgacccaacggacccaacccactcgtctacc

SEQ ID NO: 417412 - DNA, 509 bp, Homo sapiens
  misc_feature: GZ8MTXP02FOT53.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaagcccccaaaactcatcatttatgatgccactaagcggccctcaggggtttctaaatcgcttctcctggctccaagtctggcacacggcctcctgacaatctctgggctccagctgagacgaggctgattacactgctgctcatatgcaggtctatctcttatgtcttcggaactgggaccaaggtcacgtctaggtcaacgcccaacggcccaacccactcgtctacc

SEQ ID NO: 417413 - DNA, 511 bp, Homo sapiens
  misc_feature: GZ8MTXP02HRP6B.19.78.H01.1.454.CMB.2.raw
  modified_base (350)..(350): a, c, t, g, unknown or other
  modified_base (429)..(429): a, c, t, g, unknown or other
  modified_base (433)..(433): a, c, t, g, unknown or other
  modified_base (446)..(446): a, c, t, g, unknown or other
  modified_base (503)..(503): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatccaaccccaaaataaacgcccccaaaactcaatcatttatgatgccactaagcggccctcaggggtttctaaatcgcttcncctgctccaagtctggcacacgcctccctgacaatctctggctccaggctgagacgaggctgattacactgctgcttanatangctagtctatctnttatgtcgtacgacgtggacaggtcaccgtctacgcaacgaccaacggcccaacccnctctacac

SEQ ID NO: 417414 - DNA, 510 bp, Homo sapiens
  misc_feature: GZ8MTXP02G909J.19.78.H01.1.454.CMB.2.raw
  modified_base (440)..(440): a, c, t, g, unknown or other
  modified_base (501)..(501): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataaagcccccaaactcatcatttatgatgcactaagcggccctcaggggtttctaaatcgcttctcctgctccaagtctggcacacggcctccctgacaatctctgggctcccaggctgaggacgaggctgattactactgctgctcatatgcaggtctatcttnttatgtctacggactggaacctaaggtccaccgtcgtagcaacgaccaacgacccaacccnctcgactac

SEQ ID NO: 417415 - DNA, 601 bp, Homo sapiens
  misc_feature: GZ8MTXP02IASOS.19.78.H01.1.454.CMB.2.raw
  modified_base (267)..(267): a, c, t, g, unknown or other
  modified_base (405)..(405): a, c, t, g, unknown or other
tcagtactctcgtgcacgaccggtgctcgatttagtgtgagtagtttgggtttgggggctttattgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatacaaccaaataaacgcccccaaactcatcatttangatgccactaacgccgccctcgtagggtttctaatcgcttctctggctccaagtctggacaacacggcctcctagacatccctcgtcgggcctcgaggcgtggaggacgaggctgtacttacgtactgctgctcatangacgtaggtcgtatcttcttagtcgttacgttacggtaacgttcgggaaccgtaacgggtcctaacccggtaccgtacggtaccaccgacccgaaccggacccccaaaccccgtacgtacgttccaccttccgttcccgttaccccacccttccctaccgaacgtacgacgtacgtacggacggcgggtcgacggg

SEQ ID NO: 417416 - DNA, 517 bp, Homo sapiens
  misc_feature: GZ8MTXP02GWXYX.19.78.H01.1.454.CMB.2.raw
  modified_base (323)..(323): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaaactcatcatttatgatgccactaagcggccctnaggggtttcaatcgcttctcctggctccaagtctggcacacggcctccctgaccaatctctgggctccgagctgaggacgaggctgattactactgcctgcttcatatgcaggtcgtatcttcttatgtcttcggaaactggggacctaaggtcaccgtctaggtcaagcccaaggcccaacccactcgctacc

SEQ ID NO: 417417 - DNA, 518 bp, Homo sapiens
  misc_feature: GZ8MTXP02ITUMX.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtacacatcaccaaataagcccccaaactcatcatttatgatgccactaagcggccctcaggggtttctaatcgcttctcctggctccaagtctggcacacggcctccctgacatctctgggctccaggctgagacgaggctgattactactgcttgcttcatatgcgaggtcgtatcttcttatgtctttcggaacttggggacctaaagggtcctacgtacctaggtcaacgcccaaggcccaaacccactcgtacacc

SEQ ID NO: 417418 - DNA, 517 bp, Homo sapiens
  misc_feature: GZ8MTXP02HN66N.19.78.H01.1.454.CMB.2.raw
  modified_base (380)..(380): a, c, t, g, unknown or other
  modified_base (406)..(406): a, c, t, g, unknown or other
  modified_base (508)..(508): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgccccaaactacatcatttatgatgcactaagcgccctcagggtttctaatcgtcttctcctggctccaagtctggcacacggcctccctgacatctcngggctccagctgaggacgaggctagnttactactgcttgcttcatactgctaggtactattctcttatgtctttacggaacgtcgggaaccaggttccacgtctaggcaacgccaacggcccaacccnctacgtcac

SEQ ID NO: 417419 - DNA, 537 bp, Homo sapiens
  misc_feature: GZ8MTXP02GXYQT.19.78.H01.1.454.CMB.2.raw
  modified_base (450)..(450): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaaattctaacttgtctcctggtaccaacatcacccaaataaacgcccccaaaactcatcatttatgatgccactaacgcgccctcgaggggtttctaaatcgcttctcctgctcaagtctggcacacgcctcctgacaatctctggctccagctgaggacgaggctagattactacgtgctgcttcgatagtgccgaaggtccgtatcctttnttagtcgtcgttacggacgtacggactaacggtcctaccgtctacggtcaacgacccgaaacgacccaacccgtactcgtactaccg

SEQ ID NO: 417420 - DNA, 516 bp, Homo sapiens
  misc_feature: GZ8MTXP02HPX0B.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaccaaataacgaccccaaactcatcaatttatgatgccactaacgcgccctcgagggtttcaatcgcttctcctgctcaagtctcggacacacggcctcctgacaatctcgtggctccgaggctggagacgaggctgacttacactgctgcttcatatgacaggtctatcttcttatcgtctttacggaacttcggggaaccaaggtcaccgtctaggcaacgcccaacgcccaaccactcgctacc

SEQ ID NO: 417421 - DNA, 810 bp, Homo sapiens
  misc_feature: GZ8MTXP02IY828.19.78.H01.1.454.CMB.2.raw
  modified_base (260)..(260): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctacttgtctctgtacanatcaccaaataacgaccccaaactcatctattatagatcgaccaactaacggccggtaccccttacggtaacggggtttttacctaaacgttccggtctttcctcccgttcgggtccttaccctaaacggttccttacgggaccaaccgtacccgggtccccttaccccgttagaacctaaacttccgttacgttcgggggcccttacccgaacgggtccgttagggaacggggaaacgcgggggtaccttaggttaaactttaacctaacgttcggtaccttacggtcccttaccgtaaatttaacgttcggacccgttaaggggtttcccgtttaatttcctttaccgttttaagttcggtttacccgttttaacccgggggtaaaacggtttaccgggggaaaaccccgttaaaacggggttaccccgttaaccccgggtttaaccccgttagggggtttaaccccaaccgggtaaccccccggtaaaaacggggtacccccccaaaaacccccggtttaccttcggtttacccctttaaacccccg

SEQ ID NO: 417422 - DNA, 522 bp, Homo sapiens
  misc_feature: GZ8MTXP02IXMM2.19.78.H01.1.454.CMB.2.raw
  modified_base (368)..(368): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctgtaccaacatcacccaaataaacgcccccaaactcatcatttatgatgccactaagcgccctcagggtttctaatcgcttctctgctccagtctggcacacgcctcccngacatctctggctcagctgagacgaggctgacttacgactgctgctacatatgcaggtctatcttcttatcgtacttacggaacttgggaacctaaaggtcctaccgtcctaggtcaacgacccaacggacccaacccctactcgtacctaccg

SEQ ID NO: 417423 - DNA, 521 bp, Homo sapiens
  misc_feature: GZ8MTXP02JTSB6.19.78.H01.1.454.CMB.2.raw
  modified_base (359)..(359): a, c, t, g, unknown or other
  modified_base (416)..(416): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctggtaccaacatcaccaaataagcccccaaactcatcatttatgatgccactaagcggccctcaggggtttctaatcgcttctcctggctcaagtctggcacncgctccctgacatctctggctccaggctggagacgaggctgattactactgctgctnatatgcaggtcgtatcttcttagtgtctttacggaacttggggacctaaagggtccaaccgtcctaagggtcaacgcccaacggcccaaccccgactcgtacacc

SEQ ID NO: 417424 - DNA, 516 bp, Homo sapiens
  misc_feature: GZ8MTXP02GO358.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcacccaaataaacgcccccaaactcatcatttatgatgccactaagcgccctcaggggtttctaaatcgcttctcctggctccaagtctggcacacggcctccctgacaatctctgggctccaggctgaggacgaggctgattacactgctgctcatatgcaggtcgtatcttcttatgtctttcggaactgggaaccaaggtcaccgtctacggtcaacgcccaaacggcccaaacccactcgtactacc

SEQ ID NO: 417425 - DNA, 504 bp, Homo sapiens
  misc_feature: GZ8MTXP02G4LOT.19.78.H01.1.454.CMB.2.raw
  modified_base (430)..(430): a, c, t, g, unknown or other
  modified_base (473)..(473): a, c, t, g, unknown or other
  modified_base (494)..(494): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaaccttgtctcctggtaccaacatcacccaaataacgcccccaaactcatcatttatgatgccactaagcgccctgagggtttctaatcgcttctcctgctcaagtctcggcacaccggcctccctagacaactctcgtgggctccgagctggaggacgaggctagattacactgctgctcatangcaggtctatctcttatgtctacggactggactagtcacgtcngtcaagcccaacgcccaaccnctcgctaccg

SEQ ID NO: 417426 - DNA, 517 bp, Homo sapiens
  misc_feature: GZ8MTXP02FYU3U.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataacgccccaaactcatcatttatgatgccactaagcgccctcaggggtttctaatcgcttctcctgctccaagtctggcacacggcctccctagacaatctctgggctccgagctgagacgagctgattacactgctgctcatatgcaggtcgtatctcttatgtcttacggaacgtcgggaccaagggtccaaccgttccgacggtcaacgcccaaacggcccaaaccccgtactcgtacctaccg

SEQ ID NO: 417427 - DNA, 508 bp, Homo sapiens
  misc_feature: GZ8MTXP02F1PMR.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcacccaaataaagccccaaactcatcatttatgatgccactaagcggccctcaggggtttctaatcgcttctcctggctcaagtctggcacacggcctcctgacaatctctgggctccaggctgagacgagactgattactactgctgctcatatgcaggtcgtatctcttatgtcttcggaactggggacctaaaggtcaccgtcaggtcaacgcccaaggcccaacccactcgtctacc

SEQ ID NO: 417428 - DNA, 537 bp, Homo sapiens
  misc_feature: GZ8MTXP02JTIUR.19.78.H01.1.454.CMB.2.raw
  modified_base (429)..(429): a, c, t, g, unknown or other
  modified_base (432)..(432): a, c, t, g, unknown or other
  modified_base (449)..(449): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcgaggggtttctaaatcgcttctcctggctccaagtctggcacacggctccctgacaatctctgggctccgagctgaggacgaggctgattactactgcttgcttanatntgcgtaggtctatcttnttagtcgttcgttacggacgtcggaacctacggtcctaccgtcgtacgtccaacgacccgaacgaccccaaccctcgtacgtactacg

SEQ ID NO: 417429 - DNA, 508 bp, Homo sapiens
  misc_feature: GZ8MTXP02HD08U.19.78.H01.1.454.CMB.2.raw
  modified_base (440)..(440): a, c, t, g, unknown or other
  modified_base (500)..(500): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaaccaaataaacgcccccaaatcatcatttatgatgaccaactaagccggccctcgtaggggtttctaaatcgcttctctgctcaagtctgcacacgcctcctgacaatctctcggctccgagctgaggacgaggctgaattactactgctgctcatatgcaggtctatctnttatgtcttacggaactgggaaccaaggtcaccgtcaggtcaagcccaagcccaaacccnctcgtcac

SEQ ID NO: 417430 - DNA, 495 bp, Homo sapiens
  misc_feature: GZ8MTXP02FT07D.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaaattctaactgtctctgtaccaacatcaccaaataaagccccaaactcatcatttatgatgccactaagcggccctcaggggtttctaatcgcttctcctggctcaagtctggcacacggcctcctgacaatctctggctccagctgagacgaggctgattacactgctgctcatatgcaggtctatctcttatgtcttcggaactgggaccaaggtcacgtctaggtcaagcccaagcccaacccactcgactacc

SEQ ID NO: 417431 - DNA, 574 bp, Homo sapiens
  misc_feature: GZ8MTXP02H5Z69.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaacccaaataaacgacccccaaactcatcatttatgatgccactaagcgccctcagggtttctaatcgcttctcctgctcaagtctggcacacgcctccctgacatctctggctcagctgagacgaggctgattactactgctagctcatatgctaggtcgttatcttacttatcgttaccgttacggaacgttagggggaaccctaaaaggggttccctaacccggttacccgttaagggtacccgaacggcccccgaaaacgggcccccaaaacccccacgtttacggtaccctaaccccg

SEQ ID NO: 417432 - DNA, 595 bp, Homo sapiens
  misc_feature: GZ8MTXP02J4ZW0.19.78.H01.1.454.CMB.2.raw
  modified_base (283)..(283): a, c, t, g, unknown or other
  modified_base (373)..(373): a, c, t, g, unknown or other
  modified_base (386)..(386): a, c, t, g, unknown or other
  modified_base (398)..(398): a, c, t, g, unknown or other
  modified_base (404)..(404): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactcctcctcactcaggacacagggtcctgggcccagtctcgccctgactcagtctgcctccgtgtctgggtctcctggacagtcgtcaccatctctgcactggaaccagcagtgatgttagaaattctaacttgctcctgtaccaacataccaacccaaataaacncccccaaaactcatctatttactgatcgaccactaacgccgaccctgtagggtttcaaatcgcttctcctgctccaagttcaggcaaccnccggcccttaccngacaatcttcgngggccnccgaggcaggagacggagctgtaactttacctctgctgactactatacgtacgtacgtacgttacgttacttacttacgttacgttacgttacgttaccggtaacggtacggtaaccgtaacggtaccgtaccgtaccgtaccgtaccgaacccgacccgaaccgaccctaaccctacctacctacctccg

SEQ ID NO: 417433 - DNA, 534 bp, Homo sapiens
  misc_feature: GZ8MTXP02JKZAZ.19.78.H01.1.454.CMB.2.raw
  modified_base (349)..(349): a, c, t, g, unknown or other
  modified_base (355)..(355): a, c, t, g, unknown or other
  modified_base (390)..(390): a, c, t, g, unknown or other
  modified_base (414)..(414): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcacccaaataacgccccaaactcatcatttatgatgccactaagccgccctacgagggtttcaatcgcttctctgctcagtcnggcacncgcctcctgacaatctctggctcagctggagacgnggctgattacacgtgctgctcatnagctaggtctactcttcttatcgtcgttacggaacgttcgggaaacccgtaaggttcctaccgttcccgtaacggtccaacgaccccaaacgggccccaaaccctacgtcgtacctaacc

SEQ ID NO: 417434 - DNA, 505 bp, Homo sapiens
  misc_feature: GZ8MTXP02HU0V5.19.78.H01.1.454.CMB.2.raw
  modified_base (330)..(330): a, c, t, g, unknown or other
  modified_base (365)..(365): a, c, t, g, unknown or other
tcagtactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcaaccaaataaagccccaaaatcatcatttatgatgccaactaagcggccctcaggggtttctaaatcgcttctctggctccaagtctggcaaacncggcctccctgacaatcctctgggctccaggctgnggacgagctgattactactgctgctcaatatgcaggtctatctctatgtcttcgaactggacaaggtcacgtcagtcagcccaagccaacccactcgcactctcgtcccacctcctcaacgagactactgacgcggctgg

SEQ ID NO: 417435 - DNA, 513 bp, Homo sapiens
  misc_feature: GZ8MTXP02FQPBD.19.78.H01.1.454.CMB.2.raw
  modified_base (436)..(436): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaaattctaactgtctctgtaccaacatcacccaaataaacgcccccaaactcatcatttatgatgccactaagcgccctcaggggtttctaatcgcttctcctggctcaagtctggcacacgcctcctgacaatctctgggctccgagctgaggacgaggctagattacactggctgctcgatatgcaggtcgtatctnttatgtcttacggactgggaccaaggtcaccgtacctaggtcaacgcccgaaacggcccaaccctactcgtactacc

SEQ ID NO: 417436 - DNA, 563 bp, Homo sapiens
  misc_feature: GZ8MTXP02HOD9O.19.78.H01.1.454.CMB.2.raw
  modified_base (440)..(440): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtacccaaacatcaaccccaaaataaacgcccccaaaactcaatcatttatgaatgccactaaagcggccctcaggggtttctaaatcgcttctcctgctccaagtctggcacacggcctccctgacaatctctggctccagctgagacgaggctgatttacactgccttgcttacattangcgtagtctactcttatttagtcgttacgttacggtaacgtcgggaaacctaacggtacctaccgttaccgtacggtaccgaacgacccgaaacggtacccaaaccccgtactacgtaccacc

SEQ ID NO: 417437 - DNA, 568 bp, Homo sapiens
  misc_feature: GZ8MTXP02HAYSB.19.78.H01.1.454.CMB.2.raw
  modified_base (272)..(272): a, c, t, g, unknown or other
  modified_base (413)..(413): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaccaaanaagccccaaactcatcatttatgatgccactaagcgccctcagggtttcaatcgcttctctgctccaagtctaggcacacgcctccctgacaatctctggctccgagctggagacgaggctgattacactgcttgccttanatagtcgacgtaggttctacttcttacttagttcgttccgttacggaacgtacgggtaaaccgtaaacggtaccgtacccggttaccgttaacggtaccgaaccggtaccccgaaaaccggtaccccaaaaccccgtacgttaccgtacctaccg

SEQ ID NO: 417438 - DNA, 570 bp, Homo sapiens
  misc_feature: GZ8MTXP02F8PU5.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaccaaataacgaccccaaactcatctatttatgatcgaccaactaacgccggccctcgtacggggtttactaatcgtcttctcctggcctacaagtctggacacgaccggccctcctagactaatctcgtcgggcctccgaggctaggagggacgaggtctagtacttactactgctgctacatagtgcgtaggttcttattcttcttagtcgttcgttacggaacgtcgggaaccgtaaaggtcctaccgtaccgtacggtaccaaccgacccgaaacggaccccaacccacgtcgtacctacc

SEQ ID NO: 417439 - DNA, 499 bp, Homo sapiens
  misc_feature: GZ8MTXP02F4T3S.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtgaaattctaactgtctctgtacacatcaccaaataaagccccaaactcatcatttatgatgccactaagcgccctcaggggtttctaaatcgcttctcctggctcaagtctggcacacggcctccctgacaatctctgggctccaggctgagacgaggctgattactactgcctgctcatatgcaggtctatctcttatgtcttcgaacgtggaccaaggtcaccgtctaggtcaacgcccaaggcccaacccactcgactacc

SEQ ID NO: 417440 - DNA, 555 bp, Homo sapiens
  misc_feature: GZ8MTXP02ITW23.19.78.H01.1.454.CMB.2.raw
  modified_base (362)..(362): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgccccaaactcatcatttatgatgccactaagcgccctcagggtttctaatcgcttctctggctccaagtctggcaacacggcctcctgacaatcctctgggctccaggctgnggcgagctgattactactgctgctcatatgcaggtcgtatctcttatgtcttacggaacgttgggaacctaagggtaccaccgttccgtaggtccgacgaccccaacggcccaaaccccgactcgtaccacctcctaccgttcccccaacccctcctacccaacgacgtacgtacctagacggcggtacgcgg

SEQ ID NO: 417441 - DNA, 505 bp, Homo sapiens
  misc_feature: GZ8MTXP02FYEQN.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtaccaacatcacccaaataacgacccccaaactcatcattatgatgccactaagccggccctcgaggggtttctaatcgcttctctgctcaagtctggcacacgcctccctgacaatctctcgggctccagctgagacgaggctgattacactgctgctcatatgcaggtcgtatctcttatgttcttacggactgggaccaaggtccaccgtctagtcaacgcccaacggcccacccactcgtactacc

SEQ ID NO: 417442 - DNA, 545 bp, Homo sapiens
  misc_feature: GZ8MTXP02HKDW0.19.78.H01.1.454.CMB.2.raw
  modified_base (368)..(368): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaacttgtctctgtaccaacatcaccaaataacgacccccaaactcatctatttatgatgaccactaagccggccctcgtagggtttctaatcgtcttctcctgctcagtctgcacacgcctccngacaatctctggctcagctgaggacgaggctgtattactactgctgcttacatagtcgcgtaggtcttatccttattagttcgttcgttacggaacgttcgggaacctaaacggtcctaccgtccgttagtacgaaccgacccgaacggacccctaaaacccgctacgtacctaccg

SEQ ID NO: 417443 - DNA, 664 bp, Homo sapiens
  misc_feature: GZ8MTXP02IK76F.19.78.H01.1.454.CMB.2.raw
  modified_base (275)..(275): a, c, t, g, unknown or other
  modified_base (477)..(477): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactgaaccagcagtgatgttagaaattctaacttgtctctgaccacatcaaccaaataacnccccaaactcatctattatgatcgaccaactaacgccggtccctacgtacgggtttactaacgtccgtctttctccgtcggtcctacctaagtctacggaccaccgaccggtccctcccgtagaacctaactcctcgtcgggcctccgaggcgtaggacgggacgagggtcctagtaacttacctacgtcgtcctgccttanattacgtcgcgtaacggttcgttaacttctttacgtttaacgttcgttaccgttacgggtaaaaccgttccggggaaacccttaaaccgggttccgtaacccggttacccgttaacggggttaccaaccggaaccccgtaaaaccggacccccaaaaccccgtaaccttccggtacccttaaccccg

SEQ ID NO: 417444 - DNA, 499 bp, Homo sapiens
  misc_feature: GZ8MTXP02FFS4L.19.78.H01.1.454.CMB.2.raw
  modified_base (493)..(493): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacctgtctctggtaccaacatcacccaaataaacgccccaaactcatcatttatgatgccactaagcggccctcaggggtttctaatcgcttctcctgctcaagtctggcacacggcctcctgacaatctctggctccaggctgaggacgaggctgattactactgctgctcatatgcaggtctatctctatgtcttcggaactgggaccaaggtcacgtccaggtcaagccaaacgccaacccacncgctac

SEQ ID NO: 417445 - DNA, 528 bp, Homo sapiens
  misc_feature: GZ8MTXP02JOZOW.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctggtaccaacatcacccaaataaacgcccccaaactcatcatttatgatgccactaagcgccctgagggtttctaatcgcttctcctgctcaagtctggcacacggccctcctgactaatctctgggctccaggctgaggacgaggctagacttacatgctgctcgatagtgactaggttctacttctactttatcgttcttacggaacgtgggaaccaaggtccaccgtcctaggtccaacgcccaacggcccaaaccctctcgtactaccg

SEQ ID NO: 417446 - DNA, 529 bp, Homo sapiens
  misc_feature: GZ8MTXP02GX2X2.19.78.H01.1.454.CMB.2.raw
  modified_base (374)..(374): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaaattctaacttgtctctgtacaacatcaccaaataacgccccaaactcatcatttatgatgaccactaacgcggccctcgtaggggtttctaatcgcttctcctgctcagtctggcacacgcctcctgacatctcnggctccgagctgagacgaggctgaattactactgctgctcatagtgacgtaggtcttatcttactttatcgttcttacggaacgttcgggaacctaaaggtccgtaccgtctacggtacaacgcccgaacggacccaaccctactcgtactaccg

SEQ ID NO: 417447 - DNA, 501 bp, Homo sapiens
  misc_feature: GZ8MTXP02FQ8D1.19.78.H01.1.454.CMB.2.raw
  modified_base (262)..(262): a, c, t, g, unknown or other
  modified_base (294)..(294): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaactgtctctgtacaanatcaccaaataaagccccaaatcatcatttangatgccactaagcggccctcaggggtttctaatcgcttctctgctcaagtctggcacacggcctcctgacaatctctggctccagctgagacgaggctgattacactgctgctcatactgcaggtctatctctatgtacttacggactgggaccaaaggtccaccgtcaggtcaacgacccaacggcccaaccccatcgtactaccg

SEQ ID NO: 417448 - DNA, 532 bp, Homo sapiens
  misc_feature: GZ8MTXP02GN6IP.19.78.H01.1.454.CMB.2.raw
  modified_base (406)..(406): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcacccaaataaacgcccccaaactcatcatttatgatgccactaagccggccctcgaggggtttctaatcgcttctcctgctcaagtctggcacacggcctccctagacaatctctggctccgagctggaggacgnggctgtattactactgctgctcatagtgcaggtctatcttcttatgttcttacggacgtcgggaacctaagggtccaccgtccgtaggtcaacgcccgaacggacccaacccgactcgtactaccg

SEQ ID NO: 417449 - DNA, 558 bp, Homo sapiens
  misc_feature: GZ8MTXP02G1EGB.19.78.H01.1.454.CMB.2.raw
  modified_base (450)..(450): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgacccccaaactcaatcatttatgatgaccactaaagccggtccctacgaggggtttctaaatccgctttctcctggccttaccaagtctaggacaccaccggtcctcccctagaacaatctctgggctcccgaggctggaggacgaggctgattacactgctgctnatatgcgtaggtctatctacttatgtacttcggacgttgggaccctaaaggtcctaccgtcctaggtcaacggaccccaaacggccccaaccccgactcgtacctacc

SEQ ID NO: 417450 - DNA, 552 bp, Homo sapiens
  misc_feature: GZ8MTXP02GYF7Z.19.78.H01.1.454.CMB.2.raw
  modified_base (262)..(262): a, c, t, g, unknown or other
  modified_base (431)..(431): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtaccaanatcaccaaataaacgccccaaactcatcatttatgatgaccactaagcggccctcaggggtttctaaatcgcttctcctggctacaagtctggcacacggcctctctgacaatctcgtggcctccaggctgaggacgaggctagtattacgtactgcttgctacattancgctagggtcttactcttactttatcgttactttacggaaacttcggggaaccaaaggggttcccaaccggttccttaaaggccaacggaccccaaacggccccaaaccccgactgtaccc

SEQ ID NO: 417451 - DNA, 562 bp, Homo sapiens
  misc_feature: GZ8MTXP02HSLQT.19.78.H01.1.454.CMB.2.raw
  modified_base (385)..(385): a, c, t, g, unknown or other
  modified_base (430)..(430): a, c, t, g, unknown or other
  modified_base (435)..(435): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcaacccaaataaacgcccccaaactcatcatttatgatcgaccactaagcgccctcgtaggggtttctaatcgcttctcctgctcaagtctggcacacgcctcctgacaatctcnggcctcagctggaggacgaggctgaattacgtatgcttgccttanatagngacgtaggtctacttcgttacttagtcgttacgttacggaacgttacggaaccgtaacggtcctaccgtacgtacggaccgaaccgacccgaaccgtaccccaaacccgtccgtaccgtacctaccg

SEQ ID NO: 417452 - DNA, 513 bp, Homo sapiens
  misc_feature: GZ8MTXP02G66UK.19.78.H01.1.454.CMB.2.raw
  modified_base (503)..(503): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcgccctcgagggtttctaatcgcttctcctgctcaagtctggcacacggcctccctgaccaatctctgggctccaggctggaggacgaggctgattactactgctgctcatatgcgaggtcgtatctcttatgtcttcggaactggaccaggtcaccgtctaggtcaacgcccaacggcccaacccnctcgtctacc

SEQ ID NO: 417453 - DNA, 585 bp, Homo sapiens
  misc_feature: GZ8MTXP02JBV88.19.78.H01.1.454.CMB.2.raw
  modified_base (266)..(266): a, c, t, g, unknown or other
  modified_base (511)..(511): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaatcagcagtgatgttggaaattctaaccttgtctctggtaccaacatcacccaaataaacgccccaaatcatcatttangatgccactaagcgccctcaggggtttctaatcgcttctctggctaccaagtctggacaacgacggcctcctgacaactctctgggcctccgaggctgggagacggaggctagtactttactactgctgctcattagtgacgtagggttacctatccttactttagtcgttccgttacggaacgtcgggaacctaacggtccgaaccgttcgtagggtcacgacccgaacggaccccaaaacccncgtctaccaccttcgtccgttcccccgcccttacccgtccgaacgacgtacgttaccgacggacggaccgggcg

SEQ ID NO: 417454 - DNA, 512 bp, Homo sapiens
  misc_feature: GZ8MTXP02G74VQ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctcctggctcaagtctggcacacggcctccctgacaatctctggctccagctgaggacgaggctgattacactgctgctcatatgcaggtcgtatctcttatgtcttacggaactgggacctaaggtcaccgtctaggtcaacgcccaaggcccaacccgactcgtactacc

SEQ ID NO: 417455 - DNA, 503 bp, Homo sapiens
  misc_feature: GZ8MTXP02IU68Z.19.78.H01.1.454.CMB.2.raw
  modified_base (315)..(315): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccacatcaccaaataagcccccaaatcatcatttatgatgccactaagcgccctnagggtttcaatcgctctctgctcaagtctggcacacgcctccctgacaatctctgggctccaggctgaggacgaggctgattacactgcttgctcatatgcaggtcgtatctcttatgtcttacggacttggggacctaaggtccaccgtctaggtcaagccccaaggccccaacccactcgtactac

SEQ ID NO: 417456 - DNA, 516 bp, Homo sapiens
  misc_feature: GZ8MTXP02HB7D5.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcacccaaataaacgcccccaaactcatcatttatgatgccactaagcggccctcagggtttctaatcgcttctcctgctcaagtctggcacacgcctcctgacatctctggctccgagctgacggacgaggctgattacactgctgctcatatgctaggtctatcgtcttatgtccgttacggacttgggaacctaaggtccaccgtctacggtcaacgcccaacggcccaacccactcgacctacc

SEQ ID NO: 417457 - DNA, 512 bp, Homo sapiens
  misc_feature: GZ8MTXP02HM08Q.19.78.H01.1.454.CMB.2.raw
  modified_base (399)..(399): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctggtaccaacatcacccaaataaagccccaaactcatcatttatgatgccactaagcgccctcaggggtttctaaatcgcttctctgctcaagtctggcaccacggcctccctgacaatctctgggctccaggctgagacgnggctgattactactgctgctcatatgcgaggtcgtatctcttatcgtcttcggaactgggaaccaggtccaccgtctacggtcaacgccaacggccaacccacgtctactacc

SEQ ID NO: 417458 - DNA, 534 bp, Homo sapiens
  misc_feature: GZ8MTXP02HQQDZ.19.78.H01.1.454.CMB.2.raw
  modified_base (423)..(423): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaacatcacccaaataaacgcccccaaactcatcatttatgatgccactaagcgccctcagggtttctaatcgcttctcctgctcaagtctcggacacacgcctcctgactaactctcgtcggctccgagctggagacgaggctagattacgtactgctgctnatagtgcgaggttctatcttcttatgttcttacggaaacgttgggaaccaaggttccaaccgtcgtaaggtcaacgacccgaacggccccaaacccgtactcgtacctacc

SEQ ID NO: 417459 - DNA, 509 bp, Homo sapiens
  misc_feature: GZ8MTXP02J3RK1.19.78.H01.1.454.CMB.2.raw
  modified_base (482)..(482): a, c, t, g, unknown or other
  modified_base (500)..(500): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctcctggtaccaacataccacccaaataaacgcccccaaactcatcatttatgatgccactaagcgccctcaggggtttctaatcgcttctcctggctccaagtctcggcaccacggccctcctgacaatctctgggctccagctgagacgaggctgacttacactgctgcttcatatgcaggttcatctcttatgtcttcgaactggaccaaggtcaccgtctagcncgacccaggcccaacccnctcgactcc

SEQ ID NO: 417460 - DNA, 524 bp, Homo sapiens
  misc_feature: GZ8MTXP02FU60P.19.78.H01.1.454.CMB.2.raw
  modified_base (434)..(434): a, c, t, g, unknown or other
tcagtactctcgtgcacgaccggtgctcgatttagtgtgagtagtttgggtttgggggtcacaagaggcaagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcaccaaataaacgcccccaaactcatcattatgatgccactaagcggccctcgtaggggtttctaatcgcttctcctggcctcaagtctaggcacacggcctcctgacaatctactgggctccaggctggaaggacgaggctagattacacttggacctgctcatangcaggtctatctcttatgtcttcggaactgggacctaggtcaccgtctaggtcaacgacccgaacggcccaaaccctctacgtactaccg

SEQ ID NO: 417461 - DNA, 542 bp, Homo sapiens
  misc_feature: GZ8MTXP02JU8FR.19.78.H01.1.454.CMB.2.raw
  modified_base (359)..(359): a, c, t, g, unknown or other
  modified_base (365)..(365): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccacatcacccaaataacgacccccaaactcatcatttatgatgccaactaacgccggccctcgtaggggtttctaatcgcttctcctgctcaagtcnggcacncgcctcctgacatctctgggctccaggctggagggacgaggctgacttactactgcttgctcatagtgcgaggttcgtatcttcttagtgtcctttacggaactggggaacctaacggtcacccgtctacggtcaacggaccccgaacggtccccaaaccccgtatcgtacctaccg

SEQ ID NO: 417462 - DNA, 503 bp, Homo sapiens
  misc_feature: GZ8MTXP02GTF1P.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtacaacatcaccaaataagccccaaactcatcatttatgatgaccactaagcggccctcaggggtttctaatcgcttctcctgctccaagtctggcacacggcctccctgacaatctctgggctccgagctgaggacgaggctgattactactgctgctcatatgcagtcgtatctcttatgtcttacggaactgggaccaaggtcacgtctaggtcaagcccaacgccaacccactcgtactac

SEQ ID NO: 417463 - DNA, 511 bp, Homo sapiens
  misc_feature: GZ8MTXP02JD8R8.19.78.H01.1.454.CMB.2.raw
  modified_base (227)..(227): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaactgtctctggtaccacatcaccaaataagccccaaactcatcatttatgatgccactaagcggccctcgagggtttctaatcgcttctcctgctcaagtctggcacgacgccctcctgacaatctctcgggctcccaggctgaggacgaggctgattacactgctgctcattagtgctaggtctaatcttcttatgttcttacggactggaacctaggtccaccgtctagtcaacgacccaacggcccaacccactcgtcacg

SEQ ID NO: 417464 - DNA, 509 bp, Homo sapiens
  misc_feature: GZ8MTXP02FXU4X.19.78.H01.1.454.CMB.2.raw
  modified_base (446)..(446): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaaagcccccaaaactcatcatttatgatgccactaagcggccctcaggggtttctaaatcgcttctcctggctccaagtctggcacacggcctccctgacaatctctgggctcccaggctgaggacgaggctgattactactgctgctcatatgcaggtctatcttntatgtctacgacgtggacagtcaccgtctagtcaacgaccgaacgcccaacccactcgtacac

SEQ ID NO: 417465 - DNA, 507 bp, Homo sapiens
  misc_feature: GZ8MTXP02GKRTC.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagccccaaactcatcatttatgatgccactaagcggccctcaggggtttctaaatcgcttctcctggctccaagtctggcacacggcctcctgacaatctctgggcctccaggctgaggacgaggctgattactactgctgctcatatgcaggtcgtatctcttatgtcttacggactggacaaggtcaccgtcaggtcaacgccaaacggcccaaccccgatcgtctacc

SEQ ID NO: 417466 - DNA, 529 bp, Homo sapiens
  misc_feature: GZ8MTXP02JYSPR.19.78.H01.1.454.CMB.2.raw
  modified_base (431)..(431): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaacgcccccaaactcatcatttatgatgaccactaagccggccctcgaggggtttctaatcgcttctcctgctcaagtctggcacacggcctccctgaccaatctctgggctcccgaggctggaggacgaggctgattactactgctgctnatatgcaggtcgtatctcttatgtctttacggaaactggggacctaaaggtccaccgtcctagtcaacgcccaaacggcccaacccactcgtacaccg

SEQ ID NO: 417467 - DNA, 517 bp, Homo sapiens
  misc_feature: GZ8MTXP02F7QIE.19.78.H01.1.454.CMB.2.raw
  modified_base (356)..(356): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccacatcacccaaataaacgccccaaactcatcatttatgatgaccactaagcggccctcgaggggtttctaatcgcttctcctgctcagtctggcacnccgcctccctgacaatctctgggcctccgagctgaggacgaggctgattacgtactgctgctacatagtgctaggtctatttctcttagtgtcttacggactgggacctaaggtccaccgtcgtagtcaacgcccaacgcccaacccgactcgtactaccg

SEQ ID NO: 417468 - DNA, 530 bp, Homo sapiens
  misc_feature: GZ8MTXP02HOXDV.19.78.H01.1.454.CMB.2.raw
  modified_base (284)..(284): a, c, t, g, unknown or other
  modified_base (358)..(358): a, c, t, g, unknown or other
  modified_base (468)..(468): a, c, t, g, unknown or other
  modified_base (514)..(514): a, c, t, g, unknown or other
tcagtactctcgtgcacgaccggtgctcgatttagtgtgagtagtttgggtttggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcaccaaataaagccccaaatcatcatttatgatgccactaagcggccctnaggggtttctaatcgcttctctggctccaagtctggcaacacggcctccctgacatcctctggctccaggctgnggacgaggctgattactactgctgctcatatgcaggtcgtaatcttcttatgttcttcggaacttgggaccaagggtcaccgtctaggtcacgacccaacgcccaacccnctcgtccactctccttccccaccctcctaccaaccgagtacgtacncgacggcggtcgacgg

SEQ ID NO: 417469 - DNA, 567 bp, Homo sapiens
  misc_feature: GZ8MTXP02HOSAE.19.78.H01.1.454.CMB.2.raw
  modified_base (449)..(449): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaaccaaataacgaccccaaactcatctaatttatgatcgaccaactaacggcggccctacgtaggggtttactaatcgtcttctccctggtctaccaagtctcggacacgaccgtcctccctagaacaactctcgtcgggcctccgagctggacggacgagctgattactactgctgctcatangcgtaggtctatctcttagtcgttcgttacggtaacgttcgggaacctaacggtcctaaccgttccgtaggtaccaacggaccccgaaacggaccccaaaccctactcgtactacccg

SEQ ID NO: 417470 - DNA, 515 bp, Homo sapiens
  misc_feature: GZ8MTXP02GRFAS.19.78.H01.1.454.CMB.2.raw
  modified_base (362)..(362): a, c, t, g, unknown or other
  modified_base (423)..(423): a, c, t, g, unknown or other
  modified_base (426)..(426): a, c, t, g, unknown or other
  modified_base (436)..(436): a, c, t, g, unknown or other
  modified_base (440)..(440): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcaccaaataaacgcccccaaactcatcatttatgatgaccactaacgcggccctcgtagggtttctaatcgcttctcctggctcaagtctggcacncgcctcctgacaatctctgggctccgagctgacggacgaggctgattactactgctgctanatngcgtagtctntctnttatcgtctacggacgtcggactacgtcctaccgtcgtacgcaacgacccgaacgacccaacctctcgtacctcg

SEQ ID NO: 417471 - DNA, 540 bp, Homo sapiens
  misc_feature: GZ8MTXP02GB42X.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaactgtctctggtaccacatcaacccaaataaacgcccccaaactcatcatttatgatgaccactaagccgccctcgaggggtttctaatcgcttctcctgctcaagtctggcacacgcctcctgaccaatctctggctccgagctggagacgaggctagattacgtactgcctgctacatagtgcctaggtctattctcttagtcgttacgtacggaacgtggaccgtaaacggtccaaccgttccgtaaggtccaacgacccgaaacggccctaacccacgtcgtactcccg

SEQ ID NO: 417472 - DNA, 503 bp, Homo sapiens
  misc_feature: GZ8MTXP02JQJBL.19.78.H01.1.454.CMB.2.raw
  modified_base (494)..(494): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtacacatcacccaaataagccccaaactcatcatttatgatgccactaagcggccctcagggtttctaatcgcttctctgctccaagtctggcacacggcctccctgacaatctctgggcctccaggctgaggacgaggctagattactactgctgactcatatgcaggtctatctcttatgtcttcggaacttgggaccaaggttcaccgtcctaggcaagcccaaggccaacccnctcgtctac

SEQ ID NO: 417473 - DNA, 517 bp, Homo sapiens
  misc_feature: GZ8MTXP02F7J2G.19.78.H01.1.454.CMB.2.raw
  modified_base (428)..(428): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctctgtaccaacatcacccaaataaacgcccccaaactcatcatttatgatgaccactaagccggccctcagttggtttctaatcgtcttcctctgctccaagtctggcaacacggcctcctgacatctctggctccgagctgaggacgaggctagattactactgctgctcatangcaggtctatctacttatgttacttcggaactcgggaaccaagtccaccgtctaggtcacgacccgaacggcccaaacccgctcgtacc

SEQ ID NO: 417474 - DNA, 518 bp, Homo sapiens
  misc_feature: GZ8MTXP02FQ0Q9.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaaatcgcttctcctggctccaagtctggcacacgggcctccctgacaatctctgggctcccaggctgaggacgaggctgattactactgctgctcatatgcaggtcgtatctcttatgtcttcggaactgggaccaaggtcaccgtcctaggtcaagcccaacggcccaaccccactacgtctacc

SEQ ID NO: 417475 - DNA, 528 bp, Homo sapiens
  misc_feature: GZ8MTXP02F5J3K.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccacatcacccaaataaacgcccccaaactcatcatttatgatgccactaagcggccctctaggggtttctaatcgcttctcctgctcaagtctggcacgaccggcctaccccgacaactctctgggcctccaggctgagacgagctgattactactgctgactcatatgcaggtctatcttcttatgttcgtacggaacgttgggaccaaacgggtcaccgttcctacggtcacgaaccaacggcccaaccccgatcgtacactttccc

SEQ ID NO: 417476 - DNA, 506 bp, Homo sapiens
  misc_feature: GZ8MTXP02FSZRU.19.78.H01.1.454.CMB.2.raw
  modified_base (395)..(395): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtaccacatcacccaaataaacgcccccaaactcatcatttatgatgccactaagcggccctcaggggtttctaatcgcttctcctgctcaagtctagcacacgcctacctgacaatctctcgggctccgagctgagacgnggctgattacgactgctgctcatatgcaggtctatctcttatgtctcggacttaggacctaaggtcaccgtcgtaggtacaacgacccgaagcccacccactcgtactacc

SEQ ID NO: 417477 - DNA, 606 bp, Homo sapiens
  misc_feature: GZ8MTXP02HNCLJ.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaaccttgtctcctgtacaacatcaaccaaataaacgccccaaactcatcatttatgatcgaccaactaacgccggccctcgtaggggtttactaaactcgtctttctcctcggcctccaagtctggacaccacggcctccctgaacctaatctcgtggcctccgaggctggaagacgagctagacttactactgtcttgcttacattagtcgacgtaggttcgttaattcttctttacgtcgttcgttaccggaaacgttcggggaaaccctaaaggggtccctacccggttaccgtacggtaaccgaaccgaaccccgaaacggacccccaaaaccccgtactaccggtttaccctacccg

SEQ ID NO: 417478 - DNA, 576 bp, Homo sapiens
  misc_feature: GZ8MTXP02IAWZN.19.78.H01.1.454.CMB.2.raw
  modified_base (226)..(226): a, c, t, g, unknown or other
  modified_base (232)..(232): a, c, t, g, unknown or other
  modified_base (454)..(454): a, c, t, g, unknown or other
  modified_base (472)..(472): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacgagggtcctgggcccagtctgccctgactcagtctgcctccgtgtctgggtctcctggacagtcggtcaccatctcctgcactggaaccngcagtnatgttagaaattctaacttgtctctgtacaacatcaaccaaataaacgccccaaatcatctactttatgatcgaccactaacgcgaccctcgtagggttctaaatcgtctctcctgcctacaagtctggacacgaccggtcctccctagaacctaatctcgtcgggcctccgaggctaggaggacggtaggctagtaacttactactgcttgcttacattanacgcgaggtctatccttnttaatcgttcttacggaacgttcggggaaactaacgggtcctaaccgtccgttaggaccaaccggtacccaaaacgacccaacccctacgtcgttacctacccg

SEQ ID NO: 417479 - DNA, 516 bp, Homo sapiens
  misc_feature: GZ8MTXP02I8492.19.78.H01.1.454.CMB.2.raw
  modified_base (354)..(354): a, c, t, g, unknown or other
  modified_base (410)..(410): a, c, t, g, unknown or other
  modified_base (503)..(503): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaatctaactgtctctgtaccaacatcacccaaataaagcccccaaaatcatcatttatgatgccactaagccggccctcgtaggggtttcaatcgcttctctgctcagtctgcacncgcctcctgacatctctcggctcgagctgaggacgaggctgattacactgctgctnatatgcaggtctatcttcttatgttacttcggacgtcggaaccaaggtctaccgtccgtaggtaccaacgtaccccgaaggtacccaaacccncgtcgacctaccg

SEQ ID NO: 417480 - DNA, 552 bp, Homo sapiens
  misc_feature: GZ8MTXP02GGVWQ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaacgcccccaaactcatcatttatgatgccactaagcggccctcaggggtttctaatcgcttctcctggctcaagtctggcacacggccctcctgacaatctcgtcgggctccgaggctggaggtacgaggctagattacctacttgctgctcatatgcagggtcttatcttctttagtcgttacgttcggaacgtggggaaccctaaagggtccctacccggtacctagggtaccaacgcccgaaacggcccaaccccgtactcgtactacccg

SEQ ID NO: 417481 - DNA, 535 bp, Homo sapiens
  misc_feature: GZ8MTXP02JCCRN.19.78.H01.1.454.CMB.2.raw
  modified_base (432)..(432): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaacgcccccaaactcaatcatttatgatgaccactaaagcggccctcgtaggggtttctaaatcgcttctcctggctcaagtctgcacacgcctcctgacaatctcgtcgggctccgagctgaaggacgaggctgattacactgcttgctcatangcgaggtcgtatcttcttaagtcgtcttacggactcgggaacctagtaccaccgtcctaacggtcaacgcccaaacggccctaaccccgactcgtacctaccg

SEQ ID NO: 417482 - DNA, 532 bp, Homo sapiens
  misc_feature: GZ8MTXP02IOY40.19.78.H01.1.454.CMB.2.raw
  modified_base (452)..(452): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaccaaataaacgacccccaaatcatcatttatgatgaccactaagccggccctcgtaggggtttctaaatcgcttctctcgctccaagtctggacacaccggccctccctagactaatctctgggcctccgaggctggaggacgaggctagtattactactgctagctcatatgactaggtctatctnttatgtcttacggacgtggaacctaaggtctaccgtcctaggtcaacgacccaacggacccaacccgactcgtactaccg

SEQ ID NO: 417483 - DNA, 547 bp, Homo sapiens
  misc_feature: GZ8MTXP02H70VL.19.78.H01.1.454.CMB.2.raw
  modified_base (416)..(416): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtacaacatcaccaaataaacgcccccaaactcatcatttatgatgccactaagcgccctcgagggtttctaaatcgcttctcctggcctccaagttctggacacaccggcctccctgacaatctctggctccagctgaggacgaggctgattactactnctgctcatatgcgaggtcgttatcttcttatcgttactttacggaacgttcgggaacctaagggtctacccggtccgtaaggtaccaacggaccccaaacggccccaaaccccgacttcgtacctaacccg

SEQ ID NO: 417484 - DNA, 537 bp, Homo sapiens
  misc_feature: GZ8MTXP02GBYJM.19.78.H01.1.454.CMB.2.raw
  modified_base (433)..(433): a, c, t, g, unknown or other
  modified_base (525)..(525): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaactgtctctgtacaacatcacccaaataacgacccccaaactcatcatttatgatgccactaagcggccctcgagggtttactaatcgcttctcctggctcagtctggcacgacgcctccctagacaactctacgtcgggctccgaggctaggaggacgaggctgtacttactactgctgctcatangcgtaggtcgtatcttcttattcgtcttacggaactggggaccaaggtcctaccgtccgtaggtcaacgtacccgaacggaccccaaacccnctacgtctaccg

SEQ ID NO: 417485 - DNA, 520 bp, Homo sapiens
  misc_feature: GZ8MTXP02H76TK.19.78.H01.1.454.CMB.2.raw
  modified_base (438)..(438): a, c, t, g, unknown or other
  modified_base (442)..(442): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcaacccaaataaacgacccccaaactcatcatttatgatcgccactaaagccggccctcgtaggggtttctaaatcgcttctcctgctccaagtctcggacacacggcctccctgaactatctctcgggctccgagctaggaggacgaggctgacttactactgctgcctnatangcaggtctatcttctatgtcttcgattcggaacagtcaccgtctagcaacgccgaacgcccaaccacgtctacctacc

SEQ ID NO: 417486 - DNA, 542 bp, Homo sapiens
  misc_feature: GZ8MTXP02J0MCD.19.78.H01.1.454.CMB.2.raw
  modified_base (531)..(531): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcaccaaataaacgcccccaaactcatcatttatgatgaccactaagccggccctcgtaggggtttctaatcgcttctcctgctcaagtctggcacacggcctccctgacaatctctgggcctcccgaggctggaggacgaggctagacttactactgcctgctcatagtgctagggttctattctactttatcgttactttcggaaacttggggaaccctaaagggtccaccgtccgtaggtcaacgcccaacggcccaaacccnctacgcctacc

SEQ ID NO: 417487 - DNA, 491 bp, Homo sapiens
  misc_feature: GZ8MTXP02GOB54.19.78.H01.1.454.CMB.2.raw
  modified_base (301)..(301): a, c, t, g, unknown or other
  modified_base (359)..(359): a, c, t, g, unknown or other
  modified_base (420)..(420): a, c, t, g, unknown or other
  modified_base (467)..(467): a, c, t, g, unknown or other
  modified_base (481)..(482): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacggggtcctgggcccagtctgccctgactcagtctgcctccgtgtctgggtctcctggacagtcggtcaccatctcctgcactggaaccagcagtgatgttggaaattctaaccttgtctctgtaccaacatcaccaaataaacgccccaaactcatcatttangatgccactaagcgcctcgagggtttctaatcgcttctctcgctccagtctggcaacncggcctcctgacaatctctgggctccaggctgagacgagctgattacactgctgctcatangcaggtctatctcttatgtctcggactggacaacgtcacgtcagtcngaaccgagccaccnncgtcacgtc

SEQ ID NO: 417488 - DNA, 536 bp, Homo sapiens
  misc_feature: GZ8MTXP02IM647.19.78.H01.1.454.CMB.2.raw
  modified_base (333)..(333): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtacacatcaccaaataaacgcccccaaactcatcatttatgatgccataagcgccctctagggttctaatcgnttctctgctcaagtctggcacacgcctccctgacaatctctgggctccgagctgagacgagctgattacactgctgctcatatcgcgtagtcgttatctctttaagtcgttcgtttacggaaacgttgggaacctaaacgggtcctaaccgttaccgtacggtacaacgacccaacggaccctaaacccacttcgacctaacc

SEQ ID NO: 417489 - DNA, 552 bp, Homo sapiens
  misc_feature: GZ8MTXP02G37LI.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtacaacatcaccaaataaacgccccaaactcatcatttatgatgaccactaagcgccctgagggtttctaatcgcttctcctggctccaagtctgacacaccggcctccctgacaatctctgggcctccgagctaggaaggacgaggctagaacttacgacttgctgcttcatagtgacgtagtcgtactcttcttatcgttacttacggacgttgggaaccctaagggtaccacccgttaccgtacgtacgaaccgacccaaacggacccaaaccccgtactcgtacctaccg

SEQ ID NO: 417490 - DNA, 514 bp, Homo sapiens
  misc_feature: GZ8MTXP02FSJMC.19.78.H01.1.454.CMB.2.raw
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtacaacatcaccaaataaacgcccccaaactcatctatttatgatgccactaagcgccctcgaggggtttctaatcgcttctcctgctcaagtctggcacacgcctcctgacaatctctggctcccagctggaggacgaggctgattacgtactgctgctcatatgctaggtcgtatctnttatgttcttacggacgtgggaccaaggtccaccgtccgtaggtcaacgcccgaaggccccaaccctactcgtactaccg

SEQ ID NO: 417491 - DNA, 533 bp, Homo sapiens
  misc_feature: GZ8MTXP02F27EB.19.78.H01.1.454.CMB.2.raw
  modified_base (521)..(521): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtgaaattctaacttgtctctggtaccaacatcacccaaataagcccccaaactcatcatttatgatgccactaagcggccctcaggggtttctaatcgtcttctctgctcaagtctgcacacgcctcctgacaatctctgggctccaggctgagacgaggctgacttacactgctgctcattatgcgtaggttctattctcttatgttactttacggaacttgggacctaaagggtcctaacccgttcctagggtaccaacgaccccgaaaggaccccaaaccccnctacgtactacc

SEQ ID NO: 417492 - DNA, 577 bp, Homo sapiens
  misc_feature: GZ8MTXP02GY2D5.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctgtaccaacatcacccaaataaacgacccccaaactcatcatttatgatcgccaactaagccggaccctcgtaggggtttctaaatcgcttctcctggctaccaagtctggacacacggccctcctagacctaatcctcgtcgggcctccgaggcctggaggacgaggtctagtacttactacgtgctgcttcattagtgcgtaggtctatcttcttagtcgttcttacggaaacgttcgggaacctaaaggtcccgtaccgtccgtaaggtaccaacgaccccgaaacggtaccccaaacccctactaccgtacctaccc

SEQ ID NO: 417493 - DNA, 566 bp, Homo sapiens
  misc_feature: GZ8MTXP02FLSQ3.19.78.H01.1.454.CMB.2.raw
  modified_base (429)..(429): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcacccaaataaacgcccccaaactcatcaatttatgatgaccactaagcgccctcagggtttctaatcgcttctctggctccaagtctggcacacggcctcctgacaatctctgggctccaggctggagacgaggctgattacactgctgctcattangccaggtcttatctacttatcgttcttacggaacgttcggggaaccctaaaagggttcctacccggttaccgtaacggttacccaacggtacccccgaaagggaccccctaaaccccaccgtacgtaccttaacccg

SEQ ID NO: 417494 - DNA, 591 bp, Homo sapiens
  misc_feature: GZ8MTXP02I0H9S.19.78.H01.1.454.CMB.2.raw
  modified_base (262)..(262): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtaccanatcaccaaataacgccccaaatcatctatttatgatcgaccactaagccggccctcgtaggggtttctaaatccgacttctcctgcctcaagtctggcaccgcggcctccgtagactaatctacgtcgggcctccgaggctaggaggacgaggctagacttactacgtgctgcttcatatcgacgtaggtcttactcttcttagtgttaccgttacggaaccgttacggggaaaccgtaaacgggttacccgtacccgttaccgttaacggggtcccaaaccggaccccgaaacggcccccaaaacccctaccgtcgtaccgtaccccg

SEQ ID NO: 417495 - DNA, 536 bp, Homo sapiens
  misc_feature: GZ8MTXP02HHUL6.19.78.H01.1.454.CMB.2.raw
  modified_base (226)..(226): a, c, t, g, unknown or other
  modified_base (264)..(264): a, c, t, g, unknown or other
  modified_base (338)..(338): a, c, t, g, unknown or other
  modified_base (522)..(522): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaacttgtctctgtaccaanatcacccaaataaacgcccccaaactcatcatttatgatgccactaagcggccctcagggtttcaatcgcttcncctgctccagtctggcacgacgcctcctgacaagtctcgtgggcctcccgagctgaggacgaggctgacttactactgctgctcatatgctagggtctatctcttattcgtcgttacggaactcggggaaccctaaaggtccaaccgttccgtaaggtccaacgcccgaacggccccaaacccnctacgtacctaccg

SEQ ID NO: 417496 - DNA, 590 bp, Homo sapiens
  misc_feature: GZ8MTXP02JK0SM.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaaccaaataaacaccccaaactcatcatttatgatcgaccaactaacgccggtcccttacgtaggggtttactaaatccgtcttctcctcggcctcctaagtctggacacgaccgccctccctagacaatcctcgtgggcctaccgaggcgtaggaggacgaggctagtattactacgttgctgctacatagtgcgtaggtcttactcttacttagtcgttacgttacggtaacggttcgggaaaccgtaacggtaccgtaccgttaccgtacggtaccgaacgaccccaaacggaccccaaccctacgtccgtacctacccg

SEQ ID NO: 417497 - DNA, 533 bp, Homo sapiens
  misc_feature: GZ8MTXP02GYYJD.19.78.H01.1.454.CMB.2.raw
  modified_base (302)..(302): a, c, t, g, unknown or other
  modified_base (359)..(359): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctgtaccaacatcaaccaaataacgaccccaaactcatcatttangatgccactaagcgccctgagggtttctaatcgtcttctcctgctcaagtctgcacncgcctcctgacatctcgtcggctccgagctggaggacgaggctgtaattactatgctgctacatatgactaggttcgtattcttacttagtcgtcgttacggaagtcggaacctaacggtccaccgtccgtaggtccaagacccgaaacggccccaaacccgtctcgactaccg

SEQ ID NO: 417498 - DNA, 511 bp, Homo sapiens
  misc_feature: GZ8MTXP02IGJHE.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtacaacatcacccaaataaagacccccaaactcatcatttatgatgccactaagcggccctgaggggtttctaatcgcttctcctgctcaagtctggcacacgctcctgacaatctctgggctccaggctgaggacgaggctgattactatgctgcttcattatgcaggtctatctcttagtgtcttacggacttgggaccaaaggtcaccgtctaggtcaagacccaaggacccaacccactcgactacc

SEQ ID NO: 417499 - DNA, 520 bp, Homo sapiens
  misc_feature: GZ8MTXP02IEMHR.19.78.H01.1.454.CMB.2.raw
  modified_base (301)..(301): a, c, t, g, unknown or other
  modified_base (359)..(359): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactaaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgcccccaaatcatcatttangatgccactagcggccctcgaggggtttctaatcgtcttctctcgctcagtctgcacncgcctcctgacactctctggctccaggctggaggacgagctgattacactgctgctcatatgcaggtctatctcttatcgtcttacggaacgtcggaccaacggtccaccgtcgtacgtccacgcccgtaacggacccacccctacgtctacctacttccc

SEQ ID NO: 417500 - DNA, 526 bp, Homo sapiens
  misc_feature: GZ8MTXP02I3B9Z.19.78.H01.1.454.CMB.2.raw
  modified_base (322)..(322): a, c, t, g, unknown or other
  modified_base (358)..(358): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcacccaaataaacgcccccaaactcatcatttatgatgccactaagcggccctnagggtttctaatcgcttctctgctcaagtctgcacncgcctcctgacaatctctgggctccgaggctggaggacgaggctgacttactactgcctgctacatatgcagggttctatcttcttatgtcgtttacggaacttgggaacctaaagggtctaccgtctagggtcaacgcccaaaggccccaacccactcgtactaccc

SEQ ID NO: 417501 - DNA, 507 bp, Homo sapiens
  misc_feature: GZ8MTXP02GVJZ2.19.78.H01.1.454.CMB.2.raw
  modified_base (375)..(375): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtaggtcaccatctcctgcactggaaccagcagtgatgttgaaattctaacttgtctctggtaccaacatcacccaaataaacgcccccaaactcatcatttatgatgccataagcggccctcaggggtttctaatcgcttctcctgctcaagtctggcacacggcctcctgacaatcnctgggctccagctgaggacgaggctagattacactgctgctcatatgcaggtcgtatcttcttatgtcttcggaactgggaccaaggtcaaccggtctaggtcaagcccaaggcccaacccactcgtctacc

SEQ ID NO: 417502 - DNA, 543 bp, Homo sapiens
  misc_feature: GZ8MTXP02HIQNM.19.78.H01.1.454.CMB.2.raw
  modified_base (531)..(531): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttatgatgaccactaagcgccctcgtaggggtttctaatcgtcttctcctggctcaagtctggcacgacggcctccctgacaatctctcgggtcctccgaggctggaggacgaggctagattactactgctgctcatatgccaggtctatcttcttagtcgtcgttacggaacgtcgggaacctaacggtccaccgtccgtacggtcaacgacccaacggccctaaacccnctcgtactaccg

SEQ ID NO: 417503 - DNA, 533 bp, Homo sapiens
  misc_feature: GZ8MTXP02IG76H.19.78.H01.1.454.CMB.2.raw
  modified_base (449)..(449): a, c, t, g, unknown or other
  modified_base (452)..(452): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaccaaataaacgaccccaaactcatctattatgatgaccactaacgccggccctcgtagggtttctaatccgtcttctcctgcctccaagtctggcacgacgcctcctagacaactctctggctccgagctagaggacgacggctgaacttactactgctgctacatatgcaggtctatcttnttntgtcttacggactcgggactaaacggtctaccgtacgtaggtacaacgacccgaacggacccaacccgacttcgacctccg

SEQ ID NO: 417504 - DNA, 550 bp, Homo sapiens
  misc_feature: GZ8MTXP02H0YZ8.19.78.H01.1.454.CMB.2.raw
  modified_base (266)..(266): a, c, t, g, unknown or other
  modified_base (432)..(432): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtcctcctggacagtcggtcaccatctcctgcactggaaccagcagtgatgttagaaattctaacttgtctctgtaccaanatcaaccaaataacgaccccaaactcatacatttatgatcgaccactaagccgccctcgtagggtttcaatcgcttctctgcctcaagtctggacacacgcctccctgactatctctgggctccgagctaggacggacgaggctagacttacacgtgctgccttanatatcgcgtaggtcttatcttcttagtcgttcgttacggaacgttcgggaacctaggtcctaccgtccgttacggtacaaccgacccgaacggccccaaacccgctcgtacctacccg

SEQ ID NO: 417505 - DNA, 518 bp, Homo sapiens
  misc_feature: GZ8MTXP02FWAFV.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaagcccccaaaactcatcatttatgatgccactaagcggccctcaggggtttctaaatcgcttctcctggctccaagtctggcacacgggccctccctgacaatctctggggctccaggctgaggacgaggctgattactactgctgctcatatgcaggtcgtatctcttatgtcttcggaactgggaccaggtcaccgtcctaggtcaagcccaaggcccaaccccactcgtctacc

SEQ ID NO: 417506 - DNA, 518 bp, Homo sapiens
  misc_feature: GZ8MTXP02JMHD6.19.78.H01.1.454.CMB.2.raw
  modified_base (445)..(445): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaacgcccccaaactcatcatttatgatgccactaagccggccctcaggggtttctaatcgcttctctgctccaagtctggcacacggcctccctgacaatctctgggctccagctgaggacgaggctgattactactgctgctacatagtgactaggtacgtatctntttatgtctttacggactggaccaaggttcaccgtacctaggtcaacgccaacggcccaaccgactcgctacc

SEQ ID NO: 417507 - DNA, 620 bp, Homo sapiens
  misc_feature: GZ8MTXP02GY714.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataacgccccaaactcatcatttatgatgaccactaagcgccctcgtagggtttctaatcgcttctcctggctcaagtctggcacacgcctcctgaccaatctcgtgggctccgagctgaggacgaggctgattactactgcttgcttcattatcgacgtacggttcgttaacttccttacgtttacgtcgtttaccgtttaacgggtaaaccggttacggggtaaaccccgtaaaggggttaccccgtaacccggttacccgttaacgggttacctaaccggaacccccgtaaaccggggaccccctaaaacccccggtaaccttccggttaccctttaaccccgg

SEQ ID NO: 417508 - DNA, 604 bp, Homo sapiens
  misc_feature: GZ8MTXP02HXSE6.19.78.H01.1.454.CMB.2.raw
  modified_base (351)..(351): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatacaacccaaaataaacgccccaaaactcaatcaatttatgatgaccactaacgcgcctcgtagggttctaaatcgcttcncctggcctccaagtctggacaccacggcctcctagaacaatctcgtggctccgagctaggaggacgaggctagaacttacgtaactggtcttcgacttacattagacgcgtaagggtctaattcttacttagtcgtactttacgggaaacttcggggaaacctaaacgggtctaacccggtaccgttaacggtaccaaccgaaccccgtaaaacgggaccccaaaaccccctaaggtccgtttaaccctaccg

SEQ ID NO: 417509 - DNA, 524 bp, Homo sapiens
  misc_feature: GZ8MTXP02FVVFO.19.78.H01.1.454.CMB.2.raw
  modified_base (352)..(352): a, c, t, g, unknown or other
  modified_base (390)..(390): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtggaaattctaactgtctctgtacaacatcaccaaataaagccccaaactcatcatttatgatgccactaagcgccctcagggtttctaatcgcttctcctgctcaagtctggcacncgcctcctgacaatctctgggcctcaggctgagtacgngctgatactactgctagctacattaatgacctagggtcttactcttcttatcgttcttacggacgtagggaccaaaggtccaccgtcctaggtccaacgaccccgaacggcccaaccccgactcgtactacccg

SEQ ID NO: 417510 - DNA, 528 bp, Homo sapiens
  misc_feature: GZ8MTXP02GMFOX.19.78.H01.1.454.CMB.2.raw
  modified_base (363)..(363): a, c, t, g, unknown or other
  modified_base (447)..(447): a, c, t, g, unknown or other
  modified_base (517)..(517): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagccggccctcaggggtttctaatcgcttctcctgctcaagtctggcacncgcctcctgacaatctctgggctcccaggctggacggacgaggctaggacttacactgctgctacatagtgctaggtctatctnttatgttcttacggacttgggaaccaaggtccaccggtctaggtccaacgccccaaaggccccaaacccnctcgtactacc

SEQ ID NO: 417511 - DNA, 581 bp, Homo sapiens
  misc_feature: GZ8MTXP02JEZSP.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccacatcacccaaataacgaccccaaactcatcatttatgatgaccactaagcggccctgtagggtttctaagtcgtacttctcctgctaccaagtctggaccacgaccggtccctccgtacgactaactctacgtcgggctccgaggctggaacgggacgaggctagtacttactacgtgtctgtctacagttatcgacgtagtacgtattcttacgttagtcgttacgttacggaacgttcgggaacctacggtacctacccgtccgttacgccgtaaccgacccgaaccggtacccaacccgtacgtcgtaccgtacccg

SEQ ID NO: 417512 - DNA, 517 bp, Homo sapiens
  misc_feature: GZ8MTXP02I8KSD.19.78.H01.1.454.CMB.2.raw
  modified_base (463)..(463): a, c, t, g, unknown or other
  modified_base (483)..(483): a, c, t, g, unknown or other
  modified_base (490)..(490): a, c, t, g, unknown or other
  modified_base (506)..(506): a, c, t, g, unknown or other
  modified_base (515)..(515): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgccccaaatcatcatttatgatgccactaagcggccctcaggggtttcaatcgcttctctggctccaagtctggcaacacggcctccctgacaatcctctgggctccaggctgaggacaggctgattactactgctgctcatatgcaggtctatctcttatgtcttcggaactgggaccaagggtcaccgtcaggtcacgcccaagcccaacccnctcgcactctcgttcccccnccctccnccaacgacgacgtacngacgcggcncg

SEQ ID NO: 417513 - DNA, 515 bp, Homo sapiens
  misc_feature: GZ8MTXP02F0CN6.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcacccaaataaagcccccaaactcatcatttatgatgccactaagcgccctcaggggtttctaatcgcttctcctggctcaagtctggcacacggcctccctgacaatctctgggctccagctgaggacgaggctgattactactgctgctcatatgcaggtctatctcttatgtcttacggactgggaccaaggtcaccgtctaggtcaacgcccaacggaccccaacccgactcgtactaccc

SEQ ID NO: 417514 - DNA, 551 bp, Homo sapiens
  misc_feature: GZ8MTXP02IOP81.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaattctaacttgtctctgtaccaacatcacccaaataaacgcccccaaactcatcatttatgatgaccactaagccggccctcgtaggggtttctaatcgtcttctcctgctcaagtctggcacaccggcctccctagaccaatctactgggcctccgaggctggacggacgaggctagtacttacgtactgctgctcgatatgactaggtcgtatctactttagtcgtcttacggaacgttcggaaccgtaacggtcacccgtaccgtacggtccaacgaccccaaacgaccccaaccccgactactctaaccc

SEQ ID NO: 417515 - DNA, 606 bp, Homo sapiens
  misc_feature: GZ8MTXP02GGL45.19.78.H01.1.454.CMB.2.raw
  modified_base (226)..(226): a, c, t, g, unknown or other
  modified_base (298)..(298): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaattctaacttgtctctgtaccacatcaaccaaataacgaccccaaatcatctatttangatgaccactaacgccggccctgtacggggtttctaagtcgtcttctccgtggcctacaacgtctacggacaccgaccggccctacccgtagacctaactcgtcgtcgggccttccgaggtcgtaggacgggtacgacgggtctagtaacttactacgtcgtctgtctacattacgtgaccgtaggttcgtattcttacttagtcgttacgttacggaacgttacgggaaccgtaaacggtccgtaaccgtacgtaacgtaccgaacgtacccgaacggtcctccggccccctacggtacccttaccg

SEQ ID NO: 417516 - DNA, 502 bp, Homo sapiens
  misc_feature: GZ8MTXP02FS21Y.19.78.H01.1.454.CMB.2.raw
  modified_base (431)..(431): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctcctgtacaacatcaccaaataaagccccaaactcatctatttatgatgccactaagcgccctcaggggtttctaatcgcttctcctgctcaagtctgcacacgcctcctgacaatctctgggctccaggctggaggacgaggctgattacactgctgctcatatgctaggtctatctnttatgtctcggactgggaccaaggtccacgtctaggtcaacgcccgaacggcccaacccgactcgctaccg

SEQ ID NO: 417517 - DNA, 533 bp, Homo sapiens
  misc_feature: GZ8MTXP02G9VF5.19.78.H01.1.454.CMB.2.raw
  modified_base (224)..(224): a, c, t, g, unknown or other
  modified_base (298)..(298): a, c, t, g, unknown or other
  modified_base (330)..(330): a, c, t, g, unknown or other
  modified_base (341)..(341): a, c, t, g, unknown or other
  modified_base (346)..(346): a, c, t, g, unknown or other
  modified_base (352)..(352): a, c, t, g, unknown or other
  modified_base (418)..(418): a, c, t, g, unknown or other
  modified_base (441)..(441): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccngcagtgatgttagaaattctaactgtctctgtacacatcaaccaaataacgaccccaaatcatcatttatgatncactaagcgccctgtaggttctaatcgcttcnctgctcagtcngcacncgtccncctagactatctctggctcgagctggacggacgaggctagtacttactacgtgctgcctatagtancgacgtaggttccttatcctttnttacgtcgttacgtacggtacgtacggaaccgtacgtaccgtaccgtacgtacgaccgaaccgaccgaaccgacccacctactcctacctcc

SEQ ID NO: 417518 - DNA, 551 bp, Homo sapiens
  misc_feature: GZ8MTXP02IAF5V.19.78.H01.1.454.CMB.2.raw
  modified_base (263)..(263): a, c, t, g, unknown or other
tcagtactctcgtgcacgaccggtgctcgatttagtgtgagtagtttgggtttggggctttattgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctgtaccaacatcaccaaataaagccccaaatcatcatttangatgccactaagcggccctcaggggtttctaatcgcttctctggctccaagtctggcaacacggcctccctgacaatcctctgggctccaggctgaggacgaggctgattacatgctgctcatatgcaggtctatcttcttatgttcttacggaacttgggaccaagggtcaccgtcctaggtcacgacccaacggcccaaaccccactcgttcaaccttccgtcggtttccccccgtcccttccctacccgaacgacgtacgtacgtacggacggcgggtacgtcgg

SEQ ID NO: 417519 - DNA, 647 bp, Homo sapiens
  misc_feature: GZ8MTXP02I90OF.19.78.H01.1.454.CMB.2.raw
  modified_base (357)..(357): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccacatcaccaaataaacgacccccaaactcatctatttatgatgccactaagcgccctcgagggtttctaatcgcttctcctgctcagtctgcacncgcctccctgacatctcgtgggctcccgaggctaggacgggacgacgggtctaggtaactttaccgtactggtcttcggccttactaacgtttacgtcgtaccggtaggggtttaccgttactttccttcgttttaagttcgtttaccggttttaaacgggaaaagttaccgggggtaaaccctaaaagggttcccgtaacccggtttaccgtacggttacccgaaaccggtacccccgaaaaccgggaccccctaaaacccccgaccgtttacgtaacccctttacccg

SEQ ID NO: 417520 - DNA, 507 bp, Homo sapiens
  misc_feature: GZ8MTXP02GQA6R.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcacccaaataaacgacccccaaactcatcatttatgatgccactaagcggccctcaggggtttctaatcgcttctcctgctcaagtctggcacacgcctcctgacaatctctgggctccgagctgaggacgaggctgattactactgctgctcatatgcagtcgtatctcttatgtcttcggactgggaccaaggtcacgtcctaggtcaacgccaacggcccaacccgactcgtctacc

SEQ ID NO: 417521 - DNA, 537 bp, Homo sapiens
  misc_feature: GZ8MTXP02H06WE.19.78.H01.1.454.CMB.2.raw
  modified_base (445)..(445): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaaataaaacgcccccaaaactcatcaatttatgatgccactaaagcggccctcaggggtttctaaatcgcttctcctggcctcaagtctggcacacggcctccctgacaatctctgggctcagctgagacgaggctagattactactgctgcttcatatgcaggtcatatntcttatgtcttcgtaacgttacggaccgtaaacgtacgaccgtccgtacggtaacgacgacccaacggacccgaaccccaaacctacgtccg

SEQ ID NO: 417522 - DNA, 519 bp, Homo sapiens
  misc_feature: GZ8MTXP02FW6I1.19.78.H01.1.454.CMB.2.raw
  modified_base (266)..(266): a, c, t, g, unknown or other
  modified_base (357)..(357): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaccaaataaacgccccaaatcatcatttangatgcactaagcgccctcagggtttctaatcgcttctctggctccaagtctggcaacacggcctcctgacatcctctgggctccaggctgnggacgaggctgattacgtatgctgctcatatgcagtcgtatctcttatgtcttggaactggaccaaggtccaccgtctaggtcaacgcccaacgcccaaaccccacgtcgtacactctccgttcccgccctcctccaacgacacgtactgacgcggctacgg

SEQ ID NO: 417523 - DNA, 584 bp, Homo sapiens
  misc_feature: GZ8MTXP02HI868.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcaacccaaataaacgacccccaaactcatcatttatgatgaccactaagccggccctcgagggtttctaatcgcttctcctggcctaccaagtctggacaccgaccggcctccctgaacctaactctctgggcctcccgaggcctggaggacgaggctagacttacactgcttgacttcgatatgacaggttctatctacttatcgtactttacgggaacgttcgggaaacctaaggggtccctaccggttccgttaaggtccaacggtacccccgaaacggcccccaaaacccgtaccttcggtacctacccg

SEQ ID NO: 417524 - DNA, 523 bp, Homo sapiens
  misc_feature: GZ8MTXP02GZBRI.19.78.H01.1.454.CMB.2.raw
  modified_base (353)..(353): a, c, t, g, unknown or other
  modified_base (366)..(366): a, c, t, g, unknown or other
  modified_base (377)..(377): a, c, t, g, unknown or other
tcagtactctcgtgcacgaccggtgctcgatttagtgtgagtagtttgggtttgggggtcacaagaggcaagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgcccccaaatcatcatttatgatgccactaagcgccctctagggtttctaatcgcttctctgctcaagtcngcacgcgcctccngacaatctacnggctccagctaggacgtacgaggctgaacttacactgcttgctacatatgcaggtcgtatctcttatcgttctcggtaacgtgggaacctaggtccaccgtacgtaggtacaacgacccgtaacggaccacccacgtcgctaaccg

SEQ ID NO: 417525 - DNA, 564 bp, Homo sapiens
  misc_feature: GZ8MTXP02ISKWX.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataaagcccccaaactcatcatttatgatgccactaacgcggccctcaggggtttctaatcgcttctctcgctccaagtctcggcacacggccctccctgacctaatcctcgtgggctcccgaggctggaggacgaggctgtattactactgactgctcatatgctaggtctatcttcttaagtcgtcttacggaaacgttgggaaccctaaacgggttccaaccggttaccttacggtccaacggcccccgaaaacggtaccccaaaccccctactacggtaccttaacccg

SEQ ID NO: 417526 - DNA, 544 bp, Homo sapiens
  misc_feature: GZ8MTXP02H0BAG.19.78.H01.1.454.CMB.2.raw
  modified_base (325)..(325): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaaccttgtctctggtaccaacatcaacccaaataaacgccccaaactcatcaatttatgatgaccactaagcggccctnagggtttactaatcgcttctcctgctcaagtctggcacacggcctccctgacaatctctgggctccaggctgaggacgaggctgattacactgctgcttcatatgcgaggtcgtatctcttatcgttacttcggaacttgggaaaccaagggtacctaaccggtccttaaggccaacgacccgaaacggcccaaaacccccgctacgtaccttaacccg

SEQ ID NO: 417527 - DNA, 520 bp, Homo sapiens
  misc_feature: GZ8MTXP02F49W4.19.78.H01.1.454.CMB.2.raw
  modified_base (294)..(294): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccacatcaccaaataacgcccccaaactcatcatttangatgccactaagcgccctcgaggggtttctaatcgtcttctcctgctccaagtctggacacacggccctccctagacaatcctctgggcctaccgaggctggaggacgaggctgattacactgctgctcatatgactaggtctatctcttatgtcgttacggaactcgggaacacggtacacctacgtcctaggtccacgacccaacggcccaacccactcgtacc

SEQ ID NO: 417528 - DNA, 578 bp, Homo sapiens
  misc_feature: GZ8MTXP02HK06D.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctctggtaccaacactacaaccaaactaaacgaccccaaactcatacatttatgatcgacactaagccggccctcgtagggtttactaatcgtcttctcctcggctacaagtctggacacacgcctcctgacatctctcgggctccagctgaggcgaggctgtattactactgcctgcttacatagtgcgtaggttctattcttactttatgttaccgtttacggaacgtcgggtaaacctaaacggttccgtaaacccggttccgtaacggtccgaaccggacccgaaacggtaccccaaacccgacttcgtacctacccg

SEQ ID NO: 417529 - DNA, 533 bp, Homo sapiens
  misc_feature: GZ8MTXP02FYVWS.19.78.H01.1.454.CMB.2.raw
  modified_base (374)..(374): a, c, t, g, unknown or other
  modified_base (421)..(421): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtaccaacatcacccaaataaagcccccaaactcatcatttatgatgccactaagcggccctcaggggtttctaatcgcttctcctgctacaagtctggcacacgcctcctgacaatcnctgggctccgagctaggacgacgaggctagattacactgctgcctanatagtcgacgtagtctactctcttagtcgttacgttacggacgtacggaacctacgtccgtaccgtcgtacggtcaacgacccgaacgacccaacccgtcgtacgtactacg

SEQ ID NO: 417530 - DNA, 578 bp, Homo sapiens
  misc_feature: GZ8MTXP02IUGMA.19.78.H01.1.454.CMB.2.raw
  modified_base (272)..(272): a, c, t, g, unknown or other
  modified_base (301)..(301): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggcacagggtcctgggcccagtctgccctgactcagtctgcctccgtgtctggtctcctggacagtcgtcacatctcctgcactggaaccagcagtgatgttaggtaattactaacttgtctctgtacacatacaccaaanaaacaccccaaactacatcattatagatnacactaagacgcctcgaggttctaatcgtctctcctgctcaacgtctcggacaccaacggcctccctcacaaactctctcggtctcgcgcgagaggacgaacggtacgtagtactactactcgtctcgtactacgtatagtacgtacgtacgttacgttacttcttacgttacgttacgttacgttacggtaacggtacggtaaccgtaacgtaccgtaccgtaccgtacgtaccgaaccgaccgaaccgaccctaaccgtaccgtacgtactaccg

SEQ ID NO: 417531 - DNA, 538 bp, Homo sapiens
  misc_feature: GZ8MTXP02I6Q39.19.78.H01.1.454.CMB.2.raw
  modified_base (524)..(524): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaagccccaaatcatcattatgatgcactaagcggccctcagggtttctaatcgcttctctggctccaagtctggcaacacggccctcctgacaatcctctgggctccaggctgaggacgaggctagattacactgctgctcatatgcaggtcgtatctcttatcgtcttacggaacttgggacctaagggtccaccgtctaggtcacgcccaaggccccaaaccctactacgtaccacctctaccgttccccaccctcctaccaacgacgtacgtaccnggacgcgggcacgg

SEQ ID NO: 417532 - DNA, 554 bp, Homo sapiens
  misc_feature: GZ8MTXP02GGOV3.19.78.H01.1.454.CMB.2.raw
  modified_base (369)..(369): a, c, t, g, unknown or other
  modified_base (423)..(423): a, c, t, g, unknown or other
  modified_base (427)..(427): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactatcctcactcaggacacagggtcctgggcccagtctgccctgactcagtctgcctccgtgtctgggtctcctggacagtcggtcaccatctcctgcactggaaccagcagtgatgttaggaaattctaacttgtctctggtaccaacatcaccaaataacgacccccaaactcatcatttatgatgccactaagcgccctctagggtttctaatcgtcttctcctgctcaagtctgcacacgcctccngacaatctctcggctaccgagctgaggacgaggctagattactactgctgctanactngacgtagtcgttatcttcttatcgttacgttacggtaacgtacgggaacctaacggttcctacccgttaccgtacggtaccaacgaccccgaaacggtaccccaaccccgtactcgtacctaacccg

SEQ ID NO: 417533 - DNA, 563 bp, Homo sapiens
  misc_feature: GZ8MTXP02GA8L2.19.78.H01.1.454.CMB.2.raw
  modified_base (404)..(404): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaacttgtctctgtaccaacatcaccaaataacgaccccaaactcatcatttatgatgccactaagcggccctcgaggggtttctaatcgcttctcctggctcaagtctggacacaccggcctccctgacaatctctggctccgaggctaggaggtacgnggctagtattactactgctgctcatatgacaggtcgtatctattatcgttacgttacggtaacgtacgggtaaccgtaaacggtaccgtaccgttaccgtacggttaccgaacgacccgaaacggtacccccaaccctacgttaccgtacttaaccccg

SEQ ID NO: 417534 - DNA, 518 bp, Homo sapiens
  misc_feature: GZ8MTXP02ISZ5O.19.78.H01.1.454.CMB.2.raw
  modified_base (276)..(276): a, c, t, g, unknown or other
  modified_base (415)..(415): a, c, t, g, unknown or other
  modified_base (421)..(421): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtacacatcaccaaataaancccccaaactcatcatttatgatgccactaagcggccctcgaggggtttctaatcgcttctcctgctccaagtctggcacacggcctccctgacaatctcgtgggctccaggctgaggacgaggctgaattatctgctnctcatngcgagcgttatcttcgttatcgttcttacggacttgggacctaaacgggtcaccgttcctagggtccaagcccaacggcccaacccactcgactacc

SEQ ID NO: 417535 - DNA, 532 bp, Homo sapiens
  misc_feature: GZ8MTXP02JXCOZ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccacatcacccaaataaacgcccccaaactcatcatttatgatgccactaagccggccctctaggggtttctaaatcgcttctcctgctcaagtctggcacacggcctccctgacaactctcgtcgggctccaggctgaggacgaggctgtattactacttgctgctcaattgtagcgaggtcgtatcttcttagtcgtcgttcggacgttggaccaaggtccaaccgtcctaggtccaacgcccaacggcccaacccgactcgactaccc

SEQ ID NO: 417536 - DNA, 541 bp, Homo sapiens
  misc_feature: GZ8MTXP02JU87B.19.78.H01.1.454.CMB.2.raw
  modified_base (530)..(530): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataacgcccccaaatcatcatttatgatgaccactaagcggccctctagggtttactaatcgcttctcctgctccaagtctggcacaccggcctccctagactaatctacgtgggacctccgaggctaggaggaccgaggctagacttacgactggcttggcttagactatgacagggtctatcttcttatcgtcttacggaactgggaaccaaggtccaccgtctaggtcaacgtcccgaaacgcccaaacccnctacgtactcc

SEQ ID NO: 417537 - DNA, 506 bp, Homo sapiens
  misc_feature: GZ8MTXP02JDV1C.19.78.H01.1.454.CMB.2.raw
  modified_base (425)..(425): a, c, t, g, unknown or other
  modified_base (438)..(438): a, c, t, g, unknown or other
tcagtactctcgtgcacgaccggtgctcgatttagtgtgagtagtttgggtttggtggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaagcccccaaactcatcatttatgatgccactaagcggccctcgtaggggtttctaatcgcttcctctgctcaagtctggcaacacggcctcctgacaatctctggctcgagctgaggacgagctgattactactgcctgctcatangcaggtctatctnttatgtctcggactggacctaggtccacgtccttaggcacgcccaacggacccaacccgactcgtacc

SEQ ID NO: 417538 - DNA, 543 bp, Homo sapiens
  misc_feature: GZ8MTXP02H9122.19.78.H01.1.454.CMB.2.raw
  modified_base (279)..(279): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaaattctaaccttgtctctgtacaacatcaccaaataaacnccccaaactcatctatttatgatgaccactaagccggccctcgtaggggtttctaatcgcttctcctgctccaagtctcggcacacggcctccctgacaatctctgggctccgagctggaggtacgaggctgacttacactgctgctcatactgctaggtctatcttcttatcgtacttacggaacgttgggaccctaaaggtcctaaccgtcgtacggtcaacgaccccgaaacggccccaaaccccacgttcgtactacccg

SEQ ID NO: 417539 - DNA, 538 bp, Homo sapiens
  misc_feature: GZ8MTXP02IR59V.19.78.H01.1.454.CMB.2.raw
  modified_base (262)..(262): a, c, t, g, unknown or other
  modified_base (297)..(297): a, c, t, g, unknown or other
  modified_base (371)..(371): a, c, t, g, unknown or other
  modified_base (419)..(419): a, c, t, g, unknown or other
  modified_base (435)..(435): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacanatcaccaaataacgccccaaactcatactatttangatgaccactaagcgccctgagggtttcaatcgcttctctgctccagtctggcacacgcctcctgacatctcgnggctcagctagagacgaggctagtacttactactgctgtctacatagngcgtaggtctatcttntttagtcgttcgttacggaacgttacggggacctaaagggtcctaacccgttcgtacggtacaaccgacccgaaacggccccaacccgtactcgtacctaccg

SEQ ID NO: 417540 - DNA, 591 bp, Homo sapiens
  misc_feature: GZ8MTXP02JH8GM.19.78.H01.1.454.CMB.2.raw
  modified_base (225)..(225): a, c, t, g, unknown or other
  modified_base (277)..(277): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaacttgtctcctgtacaacatcaccaaataacnccccaaactcatcatttatgatcgaccactaacgccggccctcgtaggggtttctaatcgtcttctcctcgctccaagtctggcacgaccggcctccgtagacaactctcgtgggcctccgaggctggacggtacgacggctgtacttactacgtgctcgctacgatatcgacgtaggtacgttatcgttacttagtcgttacgttacggaacgttacggggaaacctaacgggtacctacccggttaccgttaacggtaccgtaaccgaccccgaaacggacccccaaacccgtaccgttcgtaccctacccg

SEQ ID NO: 417541 - DNA, 533 bp, Homo sapiens
  misc_feature: GZ8MTXP02JHU5O.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccaacatcacccaaataaacgcccccaaactcatcatttatgatgccactaagccggccctcgtaggggtttctaatcgcttctcctgctccaagtctggacacgacggcctccctgacaatctctgggctcccgaggctggacggacgagtctagattactactgctgctcatatgctaggtcgtatcttcttatgtcttacggacttgggaccaaggtccaccgtctaacggtcaacgcccaaacggcccaacccacgtctactacc

SEQ ID NO: 417542 - DNA, 576 bp, Homo sapiens
  misc_feature: GZ8MTXP02I7NGL.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctgtaccaacatcacccaaataaacgcccccaaatcatcattatgatgccactaagcggccctcgagggtttctaatcgcttctctgctcaagtctcggacacgacgcctcctagacaatctctcgggcctccgaggctaggaacgggacgaggcttgtaacttacgtactgcttgctacatagtcgcgtaggtcgtattcttatttagtcgttcgttacggaacgttacgggaacctaaacgggttcctaaccgttaccgtacggtccaaccgtaccccgaaacggtacccccaaaaccctccgtacgtaccttacccg

SEQ ID NO: 417543 - DNA, 524 bp, Homo sapiens
  misc_feature: GZ8MTXP02FUMB5.19.78.H01.1.454.CMB.2.raw
  modified_base (430)..(430): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctactggacagtcggtcaccatctcctgcactggaaccagcagtgatgttggaaattctaaccttgtctcctggtaccaacatcacccaaataaacgcccccaaactcatcatttatgatgccactaagcgccctcaggggtttctaatcgcttctcctggctcaagtctggcacacggcctccctgacaatctctgggctccaggctggagtacgaggctgattactactgctgctacatangcaggtcgtatctcttatgtcttcggaacgttgggaccaaaggtccaccgtcgtaggtcaacgtcccaaacggcccaaccccgactcgtctacc

SEQ ID NO: 417544 - DNA, 512 bp, Homo sapiens
  misc_feature: GZ8MTXP02I7HUZ.19.78.H01.1.454.CMB.2.raw
  modified_base (367)..(367): a, c, t, g, unknown or other
  modified_base (422)..(422): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccacatcaccaaataaacgcccccaaactcatcatttatgatgaccactaagcgccctcgaggggtttctaatcgcttctctgctcaagtctggcacacgcctccngacatctctgggctccaggctggagacgacggctgattacgtactgctgctcatntgcaggtctatctcttatgttcttacggactgggacctaaaggtccaccgtcgtagtcaacgcccaacggcccaacccactcgactaccg

SEQ ID NO: 417545 - DNA, 618 bp, Homo sapiens
  misc_feature: GZ8MTXP02GXTGN.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcaccaaataaacgcccccaaactcatcatttatgatgccaactaacgcggccctacgtaggggtttctaacgtcgcttctcctgctcaagtctggcaccacggccctccgtagacaactctctcgggctaccgagccgtaggacggacgaggctaggtaacttacctacgtgtcctagtaccttactaattagtcgacgtacggttacgttattaccgttactttaagttcgttaccgtttacgggaacgttcggggaaccctaaacgggttcccaacccgttaccgtacggttacccgaacgaacccccgaaacggaccccctaaccccaccgttcgtacccttacccg

SEQ ID NO: 417546 - DNA, 511 bp, Homo sapiens
  misc_feature: GZ8MTXP02GL55D.19.78.H01.1.454.CMB.2.raw
  modified_base (421)..(421): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctcctgctcaagtctggcacacggcctcctgacaatctctggctccaggctggagacgaggctgattactactgctgctnatatgcaggtctatctcttatcgtcttcggaactggaaccaaggtcaccgtctaggtcaagcccaacggcccaacccactcgtacctacg

SEQ ID NO: 417547 - DNA, 598 bp, Homo sapiens
  misc_feature: GZ8MTXP02H1LRC.19.78.H01.1.454.CMB.2.raw
  modified_base (261)..(261): a, c, t, g, unknown or other
  modified_base (275)..(275): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacanatcaccaaataacnccccaaatcatcatttatgatcgacactaagccggccctgtagggtttcaagtcgcttctctgcctcaagtctggacacgacggtcctccctagactactctcgtcgggcctaccgagtctaggacggtacgacggctagaactttacgtaacgtggtccttcggtaccttaccgaagttaacgtcggacccgttaagggtccgtttaaactcgtttacctttagtacgttacgtttacggaacgttacggaaccgtaacggtcgtacccgttacgttaacgcaaccgaccgaaacggaccccaaacctcgtcgtactacccg

SEQ ID NO: 417548 - DNA, 733 bp, Homo sapiens
  misc_feature: GZ8MTXP02GONKE.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcactggaaccagcagtgatgtgaaattctaactgtctctgtaccaacatcacccaaataaacgacccccaaactcatcaatttatgatgccaataacgcgccctacaggggtttactaaatcgcttctcctggcctacaacgtcgtacggaccaccgaccggtccttcccacgaacctaaacttcctacgttcggggccttacccgaacgggtccttagggaacgggaacggaacggggtcttacgggtaactttaaacctacgtttacggacccttagggtccccttacgtaacttttaagtcggaacccgtagggggtttaccgtttaaacgttccgtttactttaacgttcggtttacccgttttaaaccggggaaaaccgtttaccggggaaacccgtaaaacgggggttacccttaaccccgggttaccgtttaaccgggtaccgaaaccggtaacccccgtaaaaccggggtaacccccaaaaacccccgtacgtttccgaccctttaacccccg

SEQ ID NO: 417549 - DNA, 578 bp, Homo sapiens
  misc_feature: GZ8MTXP02I6BTZ.19.78.H01.1.454.CMB.2.raw
  modified_base (259)..(259): a, c, t, g, unknown or other
  modified_base (274)..(274): a, c, t, g, unknown or other
  modified_base (383)..(383): a, c, t, g, unknown or other
  modified_base (401)..(401): a, c, t, g, unknown or other
  modified_base (412)..(412): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttgaaattctaacttgtctctgtacanatcaaccaaataacnccccaaatcatctatttatgatgaccactaagccgtccctcgtagggtttactaatcgtcttctccgtggcctacgaagtcacggacacgaccgcctccagacatctcnggctcgagctggagacgngctgtactacnctagctgctacatatgactaggttctattcttcttatcgttactacgggtaacgtacgggtaaacccgtaaacggtcctacccggttaccgttaacgggtacccaaccggaccccgtaaaaccggaccccctaaaaccccgtacgttcccggtacctttaaccccg

SEQ ID NO: 417550 - DNA, 624 bp, Homo sapiens
  misc_feature: GZ8MTXP02IXYT6.19.78.H01.1.454.CMB.2.raw
  modified_base (207)..(207): a, c, t, g, unknown or other
  modified_base (231)..(231): a, c, t, g, unknown or other
  modified_base (299)..(299): a, c, t, g, unknown or other
  modified_base (402)..(402): a, c, t, g, unknown or other
  modified_base (450)..(450): a, c, t, g, unknown or other
  modified_base (465)..(465): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccntctcctgcactggaaccagcagtnatgttagaaattctaactgtctctgtacacactacaacccaaataacgcccccaaatcatctatttanagatacgaccagtaacgccggtaccctacggtacgggtttctaactccgtcttctccgtcggtctaccgtaagtctacggaccaccgccggtccctaccgtanacctaacttccgtacggtgtccctcggacgtccgtaggacggtaccgnggtctagtacttacncgtgctcgcttacatgacgtcgtaggttactattcttacgttagtcgttaccgttaacggacgtaccgggtaaccgtaacggttaccctaccggtaccgtaacggtaccaaccgtaacccgaaccggacccctaaccgcgttacctaccctttaacccg

SEQ ID NO: 417551 - DNA, 541 bp, Homo sapiens
  misc_feature: GZ8MTXP02HUM7V.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatacaacccaaataaacgacccccaaactcatactatttatgatcgaccactaacgccgtccctcgtaggggtttctaatcgcttctcctgtctaccaagtctcggacacacggccctcctgaccatctctgggactcgagctggaggacgaggtctgacttacactgctgctcatagtgacgaggttctatcctattatgttcttcgaacgtgggacctaacggtcaccgtcctaggtccaacgaccaacggcccaacccactcgtactaccg

SEQ ID NO: 417552 - DNA, 512 bp, Homo sapiens
  misc_feature: GZ8MTXP02IZTVU.19.78.H01.1.454.CMB.2.raw
  modified_base (353)..(353): a, c, t, g, unknown or other
  modified_base (361)..(361): a, c, t, g, unknown or other
  modified_base (370)..(370): a, c, t, g, unknown or other
  modified_base (377)..(377): a, c, t, g, unknown or other
  modified_base (501)..(501): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataaacgccccaaactcatcatttatgatgaccactaagcgccctgagggtttctaatcgcttctctgctcagtctgcacncgcctccngacatctcnggctcgngctgacgacgaggctagattacacgtgcttgcttcaatgtgctaggtctatctcttatgtcttcggacttgggacctaaggtcctaccgtctaggtcaacgtacccaacggacccaaacccgtntcgtactaccg

SEQ ID NO: 417553 - DNA, 560 bp, Homo sapiens
  misc_feature: GZ8MTXP02HF11I.19.78.H01.1.454.CMB.2.raw
  modified_base (362)..(362): a, c, t, g, unknown or other
  modified_base (422)..(422): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataacgcccccaaactcatcatttatgatgccactaagcgccctcgagggtttctaatcgcttctcctgctccaagtctgcacncgctccctgacaatctcgtggctcccagctgagacgagctgattactactgctgccttanatagtgcgtacggttactattcttacttagtcgttacgttacggtaacgttacgggaaaccgtacggtacctacccgtaccgtacgtaccgaaccgtaacccgaaaccgaccccaaacccgtacgtaccgtacctccg

SEQ ID NO: 417554 - DNA, 565 bp, Homo sapiens
  misc_feature: GZ8MTXP02GQ2N9.19.78.H01.1.454.CMB.2.raw
  modified_base (440)..(440): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataacgcccccaaactcatctatttatgatgaccactaagccggccctcgtaggggtttctaatcgcttctcctgctcaagtctggacacgaccggccctccctgacctaatcctcgtcgggcctccgaggctaggaggacgaggctagtaacttacactgctgcttanactagtcgacgtaggttcgttatcttattagtcgttacttacggaacgtgggaacctaaaggtcctaccgtcgtaggtccaacgtaccccgaaacggaccccaacccctacgtcgtacctacccg

SEQ ID NO: 417555 - DNA, 521 bp, Homo sapiens
  misc_feature: GZ8MTXP02HLTFI.19.78.H01.1.454.CMB.2.raw
  modified_base (297)..(297): a, c, t, g, unknown or other
  modified_base (355)..(355): a, c, t, g, unknown or other
  modified_base (364)..(364): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcaccaaataacgccccaaatcatcatttangatgccactaagcgccctcaggggtttctaatcgcttctcctgctcaagtctggcacncggcctccngacatctctgggctccgagctgaggacgagctgacttacatgctagcttcatatgcaggtctatctcttatgtcgtttacggaactcgggaacctagggtcctaccgtcctaacggtcaacgacccaacggaccccaacccgtactcgtactacccg

SEQ ID NO: 417556 - DNA, 544 bp, Homo sapiens
  misc_feature: GZ8MTXP02F3PHD.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaactgtctctgtaccaacatcacccaaataaacgcccccaaactcatcatttatgatgccactaagcgccctcgaggggtttctaatcgcttctcctgctcaagtctggcacacgcctcctgacaatctctcgggctcccgaggctagaggacgaggctagattactactgctgctcatatgcaggtcgtattctcttatgttcttacggaacgttcgggacctaaacgggttccacccggttaccgtaggtccaacgaccccgaaacggacccccaaaccccgtactacgtacctacccg

SEQ ID NO: 417557 - DNA, 767 bp, Homo sapiens
  misc_feature: GZ8MTXP02HR077.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtacaacatacaccaaataacaccccaaactcatctatttatgatgaccaactaacgccggtcccttacgtacggggttttactaaacgttccgtctttcctcccgtcgggtccttacccgaaaggttccttacgggaccaacccgtacccgggtccccttacccccgttacgaaacctaaacttccttccggtcgggggtaccttccccggaagggtccgttagggaacggggacggacggggtacttacggtaactttacctaacgtcggtccttcggtacctttacgaatttaacgtcggtaccgtaacggggttcgttaacttcctttacttttaagtcggtttaccgtttaaccggggtaaaaccggttacggggtaaacccgtaaacggggttaccctaaccccgggttaccgttaaaccgggttaccgtaaacccggtaacccccggaaaaccgggtaccccccaaaaaccccctacggttccggttaacccttaaccccgg

SEQ ID NO: 417558 - DNA, 524 bp, Homo sapiens
  misc_feature: GZ8MTXP02F45FF.19.78.H01.1.454.CMB.2.raw
  modified_base (300)..(300): a, c, t, g, unknown or other
  modified_base (365)..(365): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacggggtcctgggcccagtctgccctgactcagtctgcctccgtgtctgggtctcctggacagtcggtcaccatctcctgcactggaaccagcagtgatgttgaaattctaaccttgtctctgtaccaacatcaccaaataaacgcccccaaatcatcatttangatgccactaagccgccctcgtaggggtttctaatcgcttctctcgctccaagtctggaccaacncggcctcctgacaatctctgggctccaggctgaggcgaggctgaattacactgctgctcatatgcaggtctatctcttatgtcttacggaactgggaccaaggtccaccgttcctacggtccacgcccgaacgaccctaaccccgatcgtactactccg

SEQ ID NO: 417559 - DNA, 501 bp, Homo sapiens
  misc_feature: GZ8MTXP02I5ZB2.19.78.H01.1.454.CMB.2.raw
  modified_base (407)..(407): a, c, t, g, unknown or other
  modified_base (410)..(410): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcacccaaataaagcccccaaatcatcatttatgatgccactaagcggccctcaggggtttctaatcgcttctctgctcaagtctggcacacgcctcctgacaatctctgggctccagctgagacgaggctgatacactgctgctnatntagcaggtctatctcttatgttcttcggaacttgggaccaaggtccaccgtcctaggtcaagtcccaacggcccaacccactcgtactacc

SEQ ID NO: 417560 - DNA, 636 bp, Homo sapiens
  misc_feature: GZ8MTXP02FJLGB.19.78.H01.1.454.CMB.2.raw
  modified_base (267)..(267): a, c, t, g, unknown or other
  modified_base (341)..(341): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaaccaaataaacgccccaaatcatctatttangatgccactaagccggccctcgtagggtttctaatcgtcttctctggctccaagtctggacacacggcctcctnacatcctcgtcggctccgaggctggacggacgaggctagattactacgtgctgctcatatgcgtaggtctattctacttagttcgttccgtacgggtaacgtcgggaaccctaacgggtccaaccccggttaccgtaacgggttaccaacccggaccccgaaaccgggacccccaaaacccccgtacgttaccggtccctaacccttcccgttacccgttccccccgtaaccccttccccgtacccgaacggaacgtaacgttaccgacggaacgggtccgggtacgtaacgggg

SEQ ID NO: 417561 - DNA, 554 bp, Homo sapiens
  misc_feature: GZ8MTXP02IGANH.19.78.H01.1.454.CMB.2.raw
  modified_base (227)..(227): a, c, t, g, unknown or other
  modified_base (278)..(278): a, c, t, g, unknown or other
  modified_base (427)..(427): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttggaaattctaactgtctctgtacacatcaccaaataaacncccccaaactcatcatttatgatgccactaacgccggccctcaggggtttcaatcgcttctctgctccaagtctggacacacggcctccctgactaatctctgggctccagctgaggacgaggctgtaattactactgcctgctcattntgcgtaggtcgttactcttcttaatgttctttacgggaacttcggggaacctaaagggtccacccggttaccgtacggttccaacggaccccgaaacggaccccaaaccccgtactcgtacctaccc

SEQ ID NO: 417562 - DNA, 603 bp, Homo sapiens
  misc_feature: GZ8MTXP02G7XVR.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaacatcaccaaataacgccccaaactcatcatttatgatgccactaagcgccctgtagggtttctaatcgtcttctccgtgctcagtctggacacgacgcctcctgacactctcgtcgggctccgagctaggacggtacgaggctagtaacttacctactggccttgcttacatacgtgaccgtaggttccttaattcctttatttagttcgttaccgtttacggggaaacgttcggggaaacccgtaaacgggttcccgtaacccggttaccgtacgggttaccaaacggacccccgtaaaacgggccccctaaaaccccgtcgttaccgtaccttaaccccg

SEQ ID NO: 417563 - DNA, 639 bp, Homo sapiens
  misc_feature: GZ8MTXP02HTB4P.19.78.H01.1.454.CMB.2.raw
  modified_base (255)..(255): a, c, t, g, unknown or other
  modified_base (262)..(262): a, c, t, g, unknown or other
  modified_base (295)..(295): a, c, t, g, unknown or other
  modified_base (337)..(337): a, c, t, g, unknown or other
  modified_base (370)..(370): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgtgtctcctggacagtcggtcaccatctcctgcactggaaccagcagtgatgttagaaattctaacttgctcngtacaanatcaaccaaataacgccccaactcatcatttangatgaccactaagccgcctctagggtttctaatcgctttccnctcgctaccagtctggcaacaccggcctcccgngaacatctcgtggcctcgagcgttggaacggaccgaggctagaacttacgattgctcgtcttcaagtaagtgacgtacgggttacgttaacttcttaccttaagttccgtttacgttaacccggggtaaaaccgttcgggggtaaaaccccgtaaaacgggtttccccgaacccgggtttaacccccttagggtaacccgtaaacccggaacccccgaaaaccgggttaccccccgaaaaaaccccctcggtttacccgttaacccccg

SEQ ID NO: 417564 - DNA, 680 bp, Homo sapiens
  misc_feature: GZ8MTXP02ITR94.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtacacatcaccaaataaacgacccccaaatcatctattatgatgaccactaacgccggaccctcgtaggggtttactaagtccgtacttcctccgtcggtcctccaagttctacggtacacgaccggtccctccctagaccaacgttctacgtcggggcctacccgaggcctaggaacggacgacgggcttacggtaattaacctacgtagtccgttagacttactaattacgttcgacgtaggttacgttcttacgttactttaacgttcgttaccgtttacgggaaaacggtttacggggaaacccgtaaaacggggttcccgtaacccggttacccgttaacgggttacccgaaccgtaacccccgtaaaccgggaaccccctaaaccccggtaaccttccggttaacccttaaccccg

SEQ ID NO: 417565 - DNA, 588 bp, Homo sapiens
  misc_feature: GZ8MTXP02H84S5.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctgggacagtcggtcaccatctcctgcactggaaccagcagtgatgttaggaaattctaacttgtctctgtaccaacatacaacccaaataaacgccccaaactcatcaatttatgatgaccactaaacgccggtccctacgtaggggtttactaaacgttcgtcttctcccgtggtcctaccaacgttctacggaccaaccaccgggtccctacccgtagaacctaaacgtctccgtcggggcctcccgaggctaggacggacgagggctgacttactactgctagcttacatatgcgaaggtctatcttacttatgtacttacggaacgttggaacctaacggtccaccgtcctacggtacaacgacccgaaacggcccaaacccactcgtaccacc

SEQ ID NO: 417566 - DNA, 658 bp, Homo sapiens
  misc_feature: GZ8MTXP02GTE5S.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatacaaccaaataaacaccccaaactcatactatttatgatcgaccaactaacgccggtccctacgtaggggttttactaattccgtctttctccgtcggtcctacctaacgtctacggacctaccgaccggtccctacccgtacgaacctaactccgtcgtcggggtcctacccgaggtacgtaggaacgggacgacggtctacgtaacttaccgtacgtgtctgtctactagttagtgtaccgtaacggttcgttacttctttactttacgttacggttccgttaacggtaaacgttacggggaaaccgtaacggttacccgtacccgttacgtacggtaccgaaccgacccgaaaccggaccccaaccccgtactaccgtacctacccg

SEQ ID NO: 417567 - DNA, 508 bp, Homo sapiens
  misc_feature: GZ8MTXP02H180R.19.78.H01.1.454.CMB.2.raw
  modified_base (418)..(418): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtacacatcaccaaataaacgcccccaaactcatcatttatgatgaccactaagcgccctcaggggtttctaatcgcttctctgctccaatctggcacacgccctccctgacatctctgggctccagctgaggacgaggctgattactactgctgctcatangcaggtctatctcttatgtcttacgacgtcggacaaggtcaccgtcctaggtccaacgacccaaaggccccaaacccgactcgtactacc

SEQ ID NO: 417568 - DNA, 530 bp, Homo sapiens
  misc_feature: GZ8MTXP02J0HRU.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccacatcaccaaataaacgccccaaactcatcatttatgatgccactaagccggccctcgaggggtttctaatcgcttctcctggctcaagtctggcacacggcctccctgacaatctctgggcctccaggctggaggacgaggctagattactactgctgctcatagtgcaggttctatcttcttatcgtcttacggaacgtgggacctaaaggtccaccgtcctacggtccaacgacccaacggccccaaccccactcgtcctaccg

SEQ ID NO: 417569 - DNA, 637 bp, Homo sapiens
  misc_feature: GZ8MTXP02IKKRF.19.78.H01.1.454.CMB.2.raw
  modified_base (223)..(223): a, c, t, g, unknown or other
  modified_base (260)..(260): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcacatctctgcactggaaccngcagtgatgttagaaattctaacttgtctctgtacanatcaccaaataacgaccccaaactcatctattatagatcgaccactaacgccggaccccttcgtaacggggtttactaaagtccgtctttctcctcggctaccaagtctggaccacgaccgcctcctagactaactctcgtggtctcccgagcgtaggacggtacggacgggtctagtaacttacgtacgtcgtcttagctacattagacgtccgtagggtacttacttcttaccgtttagtacggttcgtttaaccggtaaacggttacggggtaaccgtaaacggtccgttacccggtaccgttaggttacccgaaccggaaccccgaaacccggacccctaaaaccccggtcttaccggttaccgttaaccccg

SEQ ID NO: 417570 - DNA, 723 bp, Homo sapiens
  misc_feature: GZ8MTXP02HM7CX.19.78.H01.1.454.CMB.2.raw
  modified_base (264)..(264): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtaccaanatacaccaaataacgaccccaaactcatctatttatgatcgaccaactaacggccggacccttacgtacggggttttactaaacttccggtcctttcctacctcggacctacccgtaaacggttctacgggaccaaccgacccgggtccccttacccgtacgaaacctaacttccgtccgtcgggggtccttacccggaagggccgttagggaaacggggtaaccggagggggtaccttaggtaactttaacgtaccgttaggtcccttaggtccttactaagttacgttacggaccgtaaggttcgttaacttccgttcctttaagttcgttccgttaacgggtaaccgttacggggaaacccgtaaacgggttacccgtacccgttaccgtaacggtacccaaccggaccccgaaaaccgggtacccccaaaccccacgttacgtaaccctttcccg

SEQ ID NO: 417571 - DNA, 546 bp, Homo sapiens
  misc_feature: GZ8MTXP02I9HPP.19.78.H01.1.454.CMB.2.raw
  modified_base (225)..(225): a, c, t, g, unknown or other
  modified_base (248)..(248): a, c, t, g, unknown or other
  modified_base (368)..(368): a, c, t, g, unknown or other
  modified_base (379)..(379): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaattctaactntctctgtacacatcaccaaataaacgccccaaactcatctatttatgatgccactaagcgccctcgtaggggtttactaatcgtcttctcctgctacaagtctaggcacgacgccctccngacaactctcngggcctcgaggctaggaggacgaggctagtaattactacgttggactgtctcattagtgcgtagtacgtattctcttagtcgttacgttacggaacgttgggaaccctaaggtcctaccgtcgtacgtacaacgacccgaacggtaccccacccagtacgtactacc

SEQ ID NO: 417572 - DNA, 567 bp, Homo sapiens
  misc_feature: GZ8MTXP02HU933.19.78.H01.1.454.CMB.2.raw
  modified_base (396)..(396): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctctggtaccaacatcaacccaaataaacgcccccaaactcatcatttatgatgccaactaacgccggccctacgtagggtttctaaatcgcttctcctggcctaccaagtctcggacacgacgcctcctcgacaactctcnggcctccgaggtctaggacggtacgagggtctagtaacttacgtacctgcttgaccttataattagtcgtacgtagggttaccttatcttcttatcgtcgttacggacgttcggaactaaggtcaccgtacgtaggacaacgacccgaacgcccaaccctctcgtactacc

SEQ ID NO: 417573 - DNA, 521 bp, Homo sapiens
  misc_feature: GZ8MTXP02FR3Y3.19.78.H01.1.454.CMB.2.raw
  modified_base (278)..(278): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttggaaattctaacttgtctctgtaccaacatcaccaaataaanccccaaactcaatcatttatgatgccactaacgcgccctctaggggtttctaatcgtcttctcctgctccaagtctggcacgcggcctcctgacaatctctggctccgagctagaggacgaggctgattactactgctgctcatatgcgagtcgtatctcttatcgtcttacggaacgttggacctaaacggtcacccgtctaggcaacgaccccaacggcccaaacccactcgtactacccg

SEQ ID NO: 417574 - DNA, 533 bp, Homo sapiens
  misc_feature: GZ8MTXP02HL30K.19.78.H01.1.454.CMB.2.raw
  modified_base (375)..(375): a, c, t, g, unknown or other
  modified_base (520)..(520): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataaacgccccaaactcatcatttatgatgacactaagcgccctcgagggtttctaatcgcttctctgctccaagtctgcacacgcctcctgactaatctcnggctccgagctgagacgagctagattactactgctgctacatatgcgaaggtctatcttactttatcgttctttacggaacgttgggaaaccaagggttccaccggtaccttaacggacaacgacccgaacggacccaaaacccnctacgttcacccg

SEQ ID NO: 417575 - DNA, 588 bp, Homo sapiens
  misc_feature: GZ8MTXP02IVQ2J.19.78.H01.1.454.CMB.2.raw
  modified_base (224)..(224): a, c, t, g, unknown or other
  modified_base (461)..(461): a, c, t, g, unknown or other
  modified_base (466)..(466): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcaccatctcctgcactggaaccngcagtgatgttagaaattctaacttgtctcctggtaaccaacatacaaccaaataaacgacccccaaactcatactattatgatgaccaactaaagccggaccctcgtaaggggtttactaaatcgactttctccgtggactacgaagttctaggacacaccggcctccctagaactaatcctcgttcgggacctccaaggctggaagacgaggctagattacgactgcctgcttanatagngacgtagtactattcttacttagttcgtacgttacggaacgtacggaaccgtaacgtaccgtaccgtacgtacgaccgaaccgaacccgaaaccgaccccaacccgtactacgtacgtaccg

SEQ ID NO: 417576 - DNA, 552 bp, Homo sapiens
  misc_feature: GZ8MTXP02HX3GQ.19.78.H01.1.454.CMB.2.raw
  modified_base (363)..(363): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataaacgcccccaaactcatcatttatgatgaccactaagcggccctgacggggtttctaatcgcttctcctgcctcaagtctggacacncgcctccctgacaatctcgtggctccgagctagagacgaggctgattactactgtctgctacatatcgactagggtcttatcttcttatcgttcgttacggaacgttcggggaacctaaagggtccctaaccggtccgtacgggtacaacgaccccgaaacggaccccaacccacgtcgtacctacccg

SEQ ID NO: 417577 - DNA, 550 bp, Homo sapiens
  misc_feature: GZ8MTXP02GDEF9.19.78.H01.1.454.CMB.2.raw
  modified_base (283)..(283): a, c, t, g, unknown or other
  modified_base (408)..(409): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtacaacatcacccaaaataaancccccaaaactcatcatttatgatgccataaagcggccctcaggggtttctaaatcgcttctcctgctccaaagtctggcacacggcctccctgacaatctctgggctccaggctgaggacaggnngatactactgctgctactatatagcgaggtacgtactcttacttatcgttcgttacggtaacgtacggaaccgtaaacggtacgtaccgtaccgtacgtacgaacgacccgaaccgacccaaaccccaacctacgtactac

SEQ ID NO: 417578 - DNA, 535 bp, Homo sapiens
  misc_feature: GZ8MTXP02GFDMN.19.78.H01.1.454.CMB.2.raw
  modified_base (295)..(295): a, c, t, g, unknown or other
  modified_base (366)..(366): a, c, t, g, unknown or other
  modified_base (382)..(382): a, c, t, g, unknown or other
  modified_base (385)..(385): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagaaattctaacttgtctctgtacaacatcaccaaataacaccccaaactcatcatttangatgcacgtaagcgccctgagggtttctaatcgtcttctcctggcctcaagtctaggcacgaccgcctccngacatctctggctcgngcngagacaggctagtacttactctgtctgtctctatatgactaggttcctattctatttatgttacgtacggaacgtcgggtaacctaagggtccaccgtacgttacggacaacggtacccgaacggacccaaccgtactcgtacttacccg

SEQ ID NO: 417579 - DNA, 520 bp, Homo sapiens
  misc_feature: GZ8MTXP02GL90R.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtacaacatcaacccaaataaagcccccaaaactcatcaatttatgatgccactaaagcggaccctcaggggttttctaaatcgtcctttctcctggctccaagtctggcacacggcctccctgacaatctctgggctcccaggctgaggacgaggctgattactactgctgctacagtatgcaggtctatctattatgtcttcggaaacttgggacaaggtcaaccgtcaggtcaagcccaaggcccaacccactctctacc

SEQ ID NO: 417580 - DNA, 542 bp, Homo sapiens
  misc_feature: GZ8MTXP02GCVFI.19.78.H01.1.454.CMB.2.raw
  modified_base (269)..(269): a, c, t, g, unknown or other
  modified_base (539)..(539): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgccccaaatcatcatttangatgcactaagcggcctcaggggtttctaatcgcttctctggctccaagtctgcaacacggcctccctgacaatcctctgggctccaggctgaggacgaggctgattactactgctgctcatatgcaggtctatctcttatgtcttacggactgggaccaagggtccaaccgtcgtaggtcacgacccaaggacccaaaccccgtactcgtaccacttcctcgtttccccaccctccctaccaacgacgtacgtactggacgcgggtacncgg

SEQ ID NO: 417581 - DNA, 540 bp, Homo sapiens
  misc_feature: GZ8MTXP02JUVU8.19.78.H01.1.454.CMB.2.raw
  modified_base (338)..(338): a, c, t, g, unknown or other
  modified_base (367)..(367): a, c, t, g, unknown or other
  modified_base (377)..(377): a, c, t, g, unknown or other
  modified_base (424)..(424): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccacatcaaccaaataaacgcccccaaactcatcatttatgatgccactaacgccgccctgagggtttcaatcgcttcncctggctccagtctggcacgcgcctcccngacatctcgngggctcgagctgacggacgaggctagtacttacgactgctgctcatncgcaggttctatcttcttagtcgttcttacggaacgttgggaacctaaggttcccaaccgtccgtaacggtccaacgccccgaaacggccccaaacccctctaccgttcctaaccg

SEQ ID NO: 417582 - DNA, 516 bp, Homo sapiens
  misc_feature: GZ8MTXP02GRXLA.19.78.H01.1.454.CMB.2.raw
  modified_base (446)..(446): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcacccaaataaagcccccaaactcatacatttatgatgccactaagcggccctcaggggtttctaatcgcttctcctggctccaagtctggcacacggcctccctgaccaatctcgtcgggctccaggctggaggtacgaggctagattactatgctagctcatatgcgagtcgtatctnttatgtctcgacgtggacaggtcaccgtctacgtcaacgacccaacggaccctacccgactcgactaccc

SEQ ID NO: 417583 - DNA, 520 bp, Homo sapiens
  misc_feature: GZ8MTXP02F8CKF.19.78.H01.1.454.CMB.2.raw
  modified_base (509)..(509): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaattctaactgtctctgtaccaacatcacccaaataaacgcccccaaactcatcatttatgatgccactaagcggccctcaggggtttctaatcgcttctcctgctcaagtctggcacacgcctccctgacaatctctgggctccagctgagacgagctgattactactgctgctcattagtgacaggtctatctcttatcgtcttacggaacgtgggaacctaagggtccacccgtcgtacggtacaacgaccccaacggcccaaccccgntcgtactaccg

SEQ ID NO: 417584 - DNA, 538 bp, Homo sapiens
  misc_feature: GZ8MTXP02I5X09.19.78.H01.1.454.CMB.2.raw
  modified_base (266)..(266): a, c, t, g, unknown or other
  modified_base (439)..(439): a, c, t, g, unknown or other
  modified_base (443)..(443): a, c, t, g, unknown or other
  modified_base (529)..(529): a, c, t, g, unknown or other
tcagtactctcgtgcacgaccggtgctcgatttagtgtgagtagtttggggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctgtaccaanatcaaccaaataacgaccccaaactcatctatttatgatgccactaagccgaccctcgaggggtttctaaatcgacttctctggcctacaagtctaggacacgacggcctccctagacaatctacgtgggccctacgaggctaggaggacgaggctagattacactgctgctnaatntgacgagtaccgtatctcttatgtcttacggaacgtgggaacctaaggtccaacgtcctaggtcaacgccaaacggcccaaacccntcgactacc

SEQ ID NO: 417585 - DNA, 513 bp, Homo sapiens
  misc_feature: GZ8MTXP02GK4HZ.19.78.H01.1.454.CMB.2.raw
  modified_base (505)..(505): a, c, t, g, unknown or other
  modified_base (512)..(512): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctggtaccaacatcaccaaataaagcccccaaactcatcatttatgatgccactaagcgccctcaggggtttctaaatcgcttctcctgctccaagtctggcacacggcctccctgacaatctctgggctcccgagctgaggacgaggctagtattactactgcttgctcatatgcaggtctatctcttatgtcttcgactgggaccaaggtcaccgtctaggtcaaggcccaaacggcccaaaccccnctcgtcnc

SEQ ID NO: 417586 - DNA, 555 bp, Homo sapiens
  misc_feature: GZ8MTXP02GE0FX.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtaccaacatcaccaaataaacgaccccaaactcatcatttatgatgccactaacgccggccctcgtacggggtttactaatcgtcttctcctggtcctacctaagtctacggacaccgaccgcctccctagactaatctcgtgggctccgaggctaggaggacgaggtctagattactactgctgctacatatgactaggtcgtatcttcttatgtcttacggacgtgggaaccaacggtccaccgtactaggtacaacgacccgaaacggacccctaaccccactcgtacctacc

SEQ ID NO: 417587 - DNA, 629 bp, Homo sapiens
  misc_feature: GZ8MTXP02J1GEF.19.78.H01.1.454.CMB.2.raw
  modified_base (363)..(363): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatacaacccaaataaacgacccccaaactcatcatttatgatgccactaagcggccctcgaggggtttctaatcgcttctcctggctccaagttcnggacaccgaccggtccctcccgtagacaagtcttccgcgggacctccgaggcctagggacgacggtaggctagtaactttacctactgacctgcttacatacgtgaccctaagggttctacttccgttatttagtcggttacgtttaccggaaaacgtttccggggaaacctaaacggggttcctaaaccccgttcgttaaccgggtaccaaccggaccccgaacgggacccccaaaacccctacggtcgtacccgtttaaccccg

SEQ ID NO: 417588 - DNA, 549 bp, Homo sapiens
  misc_feature: GZ8MTXP02ITHAL.19.78.H01.1.454.CMB.2.raw
  modified_base (226)..(226): a, c, t, g, unknown or other
  modified_base (365)..(365): a, c, t, g, unknown or other
  modified_base (375)..(375): a, c, t, g, unknown or other
  modified_base (432)..(432): a, c, t, g, unknown or other
  modified_base (439)..(439): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacagtcggtcaccatctcctgcactggaaccngcagtgatgttaggaaattctaacttgtctctgtaccaacatcacccaaataaacgacccccaaactcaatcatttatgatgaccactaagcggccctcgtaggggtttctaaatcgcttctcctgctcaatctgcacncggcctcccngactaatctctgggcctcgaggctggaaggacgaggctgtattactactgcttgctnatatcgntagggttctatcttcttagtgtacgtttacggaacttcggggaacctaaaggtcctaaccgtccgtaggtcaacgacccgaacggccccaaacccgactacgtacctacc

SEQ ID NO: 417589 - DNA, 666 bp, Homo sapiens
  misc_feature: GZ8MTXP02I8406.19.78.H01.1.454.CMB.2.raw
  modified_base (306)..(306): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcaaccaaataacgacccccaaactcatctatttatgatnaccactaacgccgtccctacgtacggggtttctaactcgtacttctctcggctcgtaagtctacggcaccgtacggccctaccgtcgactaacttcgtcgttcgggcctaccgaggcgtggaacggtacgaggtctaggtacttacgtactcgcttcggcttacattgtacgtacgttacgggtacttaacgttactttcgttaagttcgtttacccggttaccgggtaaacggttaccgggggaaacccttaaacggggttccgttaaccccggttaccggttaacggttacccgaaccggtaccccgaaaacccggttcccccaaaccccgtacgtttacgtacccgtttaaccccgg

SEQ ID NO: 417590 - DNA, 559 bp, Homo sapiens
  misc_feature: GZ8MTXP02HGJ5B.19.78.H01.1.454.CMB.2.raw
  modified_base (329)..(329): a, c, t, g, unknown or other
  modified_base (338)..(338): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaccaaataaacgccccaaatcatcatttatgatgccactaagcggccctcgagggtttctaatcgcttctctcggctccaagtctggcaacncggcctccngacaatcctcgtggctcgaggctgaggacgagctgattacactgctgctacatatgcgtaggtcgttatcttcttatgtcgttacggaacgttcgggacctaacggtaccaccgtaccgtacggtccaacggacccgaaacgcccaaacccccgtactcgtacctacctcgtccgtacccctaccctcctccaaccgagtacgtactgacggcggcgtcgg

SEQ ID NO: 417591 - DNA, 636 bp, Homo sapiens
  misc_feature: GZ8MTXP02J302A.19.78.H01.1.454.CMB.2.raw
  modified_base (313)..(313): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtaggaaccagcagtgtattggttaggaaacttctaaccttgtcttcctggtaccaacataccaacccaaataaacgccccaaactcatcatttangatgaccactaagccgccctcgtagggtttcaatccgcttctcctaggcctccaagttctacggacaccgacggccctcctagacaactctcgtgggccctcgacggtcaggacggacggaggtacctgtaactttactactcggtcttgctacataacgttgaccgtagggttactaattcttctttagttacgttactttaccgggaaacgtttcggggaaacccgtaaacgggttccctacccgttaccgtacggggttacccaacggacccccgaaacgggccccctaaaaccccgtccgttaacgtcccttaaccccg

SEQ ID NO: 417592 - DNA, 549 bp, Homo sapiens
  misc_feature: GZ8MTXP02HY4MM.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgattgttggaaattctaaccttgtctctgtaccaacatcaaccaaataacgcccccaaatcatcatttatgatacgaccactaagccgccctacgtagggtttcaatcgcttctctgctcaagtctggcacgcgcctccctgacatctcgtcggctccgagctaggaaggacgaggctagacttactactgctgactacatagtcgcgtaggtcttatcttattatcgttcgttacggaacgttgggaacctaagggtcctaccgtacctacggtacaaccggtacccaaacggcccaaaacccgcttcgtacctaccg

SEQ ID NO: 417593 - DNA, 541 bp, Homo sapiens
  misc_feature: GZ8MTXP02I7P0D.19.78.H01.1.454.CMB.2.raw
  modified_base (442)..(442): a, c, t, g, unknown or other
  modified_base (460)..(460): a, c, t, g, unknown or other
  modified_base (529)..(529): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataaacgccccaaactcatcatttatgatgaccactaagccggccctcgtacggggtttctaaatccgtcttctcctgctccaagtctggacacaccggccctccctagaccaatcctcgtgggcctccgaggctagaggacgaggctgattactactgctgctcatangctaggtcgttatcgttnttagtgtcgttacggacttcgggacctaaggtcctaccgtctaggtcaacgacccaacggcccaacccnctcgtactaccg

SEQ ID NO: 417594 - DNA, 710 bp, Homo sapiens
  misc_feature: GZ8MTXP02H94ZT.19.78.H01.1.454.CMB.2.raw
  modified_base (266)..(266): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcacatctcctgcactggaaccagcagtgatgttaggaaattctaaccttgtctctgtacaanatcaccaaataacgccccaaactcatcatttatgatcgaccactaagccggtccctcgtaggggtttctaatcgcttctcctggtcctccaagtctaggctacacggcctccctagacctaatctcgtcgggctccgagggctagggaggtacggacggtacgtcgtaactttaccgtacgttcggaccgttcggtacccttaccgtaatttaacgccgggtaccgtaacgggggtttaccgtttaaccgttaccgtttcctttaagtttcggtttacccgtttaaaccgggggtaaaccgttaccgggggtaaaccctaaaacgggggttccccctaacccgggtttacccgttaaacggggttacccgaaaccggtaaccccccgtaaaaccggggaccccccttaaaacccccgaaccgttttcggacccctttaaccccg

SEQ ID NO: 417595 - DNA, 524 bp, Homo sapiens
  misc_feature: GZ8MTXP02FEXRM.19.78.H01.1.454.CMB.2.raw
  modified_base (191)..(191): a, c, t, g, unknown or other
  modified_base (224)..(224): a, c, t, g, unknown or other
  modified_base (259)..(259): a, c, t, g, unknown or other
  modified_base (292)..(292): a, c, t, g, unknown or other
  modified_base (492)..(492): a, c, t, g, unknown or other
  modified_base (516)..(516): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctcgtgtctgggtctccnggacagtcgtcaccatctcctgcactggaaccngcagtgatgtagaaattctaactgtctctgtacanatcaccaaataacgccccaaactcatcatttangatgccactaacgccggccctcgaggggtttctaatcgtcttctcctcggcctcaagtctcggacacaccggcctcctgacaatctctcgggctccgaggctggaggtacgaggtctagtatacgtactgctgctcatactgcctaggtcgttatcttcttagtcgtactacggaactgggaccaacggtcaccgttacnggtacaacgaccaacgccaacccntcgctacc

SEQ ID NO: 417596 - DNA, 623 bp, Homo sapiens
  misc_feature: GZ8MTXP02HKDDN.19.78.H01.1.454.CMB.2.raw
  modified_base (286)..(286): a, c, t, g, unknown or other
  modified_base (403)..(403): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtaccaacatcacccaaaataaacncccccaaactcaatcatttatgatcgaccactaacgcggccctacgtacgggtttctaatcgtctttctcctcgcctccaagtctaggacacgaccgcctccctgacctaatctcgngggctccgagctggaaggacgaggtcctagtacttacgtactggccttgcttacaattatcgtaccgaaggtttctaacttcttctttaagtcgtaccgtttacgggaaaccggtcgggtaaaccctaaacggttcccgaacccggttaccgtaggtaccaaccgggaccccctaaaacgggtacccccaaaaccccgttacctcggttacccttacccg

SEQ ID NO: 417597 - DNA, 530 bp, Homo sapiens
  misc_feature: GZ8MTXP02G6JXI.19.78.H01.1.454.CMB.2.raw
  modified_base (271)..(271): a, c, t, g, unknown or other
  modified_base (496)..(496): a, c, t, g, unknown or other
  modified_base (520)..(520): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaaatcatcatttangatgccactaagcggccctcaggggtttctaatcgcttctctggctccaagtctggcaacacggcctcctgacaatcctctggctccaggctgaggacgaggctgattactactgctgctcatatgcaggtctatctctatgtcttcggacttgggaccaagggtcaccgtctaggtcacgacccaacggcccaaacccctactcgtacacctcctcggtccccnccctcctccaacgacgacgtacgngacgcgcgcg

SEQ ID NO: 417598 - DNA, 594 bp, Homo sapiens
  misc_feature: GZ8MTXP02HCY0G.19.78.H01.1.454.CMB.2.raw
  modified_base (474)..(474): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttaggaaattctaacttgtctcctggtaccaacatcaacccaaaataaacgacccccaaaactcaatacatttaactgatgaccaactaaacgcggccctacgtaggggtttactaaatccgtctttctccctggtcctccaaagtctggacaaccgaccggcctccctagaactaatcctcgtgggcctccgagccgtaggacggacgagggctagaacttactacgtgctgccttanatagtgacgtagtcgtactcttacttagtcgtacgtacggaacgtacggaaccgtacgtaccgaccgtacgtacgaccgaacgacccgaaccgaccccaaacccgtctacgtacctaccg

SEQ ID NO: 417599 - DNA, 622 bp, Homo sapiens
  misc_feature: GZ8MTXP02H1RC2.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctcctgcactgaaccagcagtgatgttagaaattctaacttgtctctgtaccaacatacaaccaaataaacaccccaaactcatacatttatgatcgaccactaacgcgtccctgtagggtttactaactcgtcttctctcgctacaagtcgtcggacacgtaccgccttacccgtagaacctaactcgtccgtcgggtcctaccgacggtcgtacggaacgggtacgaggtctacgtaacttacgtacgtcgtcttgacttactagtagtcgacgtacggttacttaatcttacttacgtcgttaccgttacggaacgtttacgggaaaccgtaaacggttaccgtacccgtaccgttaacggacccgaaccgaaccccgaacggacccctaaaccctacgtccgtacctacccg

SEQ ID NO: 417600 - DNA, 525 bp, Homo sapiens
  misc_feature: GZ8MTXP02HMTCA.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcaccccaaaataaagacccccaaactcaatcatttatgatgaccactaaagcggccctcgaggggtttctaaatcgcttctcctggctccaagtctggcacacgcctccctgacaatctctggctccagctgagacgaggctagattacactgctgctcatatagcagtcgtatctcttatgtcttcgtacgtacggacgtaacgtactaccgtaccgtacgtacgaacgccaacggaccaacccacctactactcc

SEQ ID NO: 417601 - DNA, 527 bp, Homo sapiens
  misc_feature: GZ8MTXP02GUUDP.19.78.H01.1.454.CMB.2.raw
  modified_base (385)..(385): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaacgcccccaaactcatcatttatgatgccactaagcggccctcaggggtttctaatcgcttctcctggctccaagtctggcacacggcctccctgacaatctcngggctccaggctggaggacgagggctagattactactgctgctcatatgcaggtctattctcttatcgtcttcggaacttgggacctaaggtcctaccgtcgtaaggtcaacgcccgaacggcccaacccactcgtactacc

SEQ ID NO: 417602 - DNA, 577 bp, Homo sapiens
  misc_feature: GZ8MTXP02H0PYL.19.78.H01.1.454.CMB.2.raw
  modified_base (437)..(437): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctgtacacatcaccaaataaacgccccaaatcatctatttatgatgaccactaagccggccctgagggtttcaatcgcttctctggtcctccaagtctaggaccacgaccgtccctccctgactaactctcgtagggcctccgaggctaggacggacgacggctaggaattacactgctgctnatatgcgtaggtcttatcttcttagtgttcgttacggacgttacgggaacctaaggtaccctaccggttaccgttacggtaccgaaccgtaccccgaaaaccggccccctaaaaccccgtcgttacggttacctaacccg

SEQ ID NO: 417603 - DNA, 560 bp, Homo sapiens
  misc_feature: GZ8MTXP02HRBQQ.19.78.H01.1.454.CMB.2.raw
  modified_base (376)..(376): a, c, t, g, unknown or other
  modified_base (456)..(456): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaacccaaataaacacccccaaactcatcaatttatgatgccactaacgccgccctcgtagggtttctaatcgcttctcctgctcaagtctggacaccacggccctccncgacaatctctggctccgagctggagacgagctagacttacactgcttgcttcattagtcgacgtaggttctattccttntttacgtcgttaccgttacggacgttagggacctaaacgggtcctacccggtcctaggtccaacggtacccgaacggaccccaaaccccgtctaccgtactacc

SEQ ID NO: 417604 - DNA, 608 bp, Homo sapiens
  misc_feature: GZ8MTXP02JRG8E.19.78.H01.1.454.CMB.2.raw
  modified_base (226)..(226): a, c, t, g, unknown or other
  modified_base (232)..(232): a, c, t, g, unknown or other
  modified_base (262)..(262): a, c, t, g, unknown or other
  modified_base (296)..(296): a, c, t, g, unknown or other
  modified_base (410)..(410): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctctgcacgtggaaccngcagtnatgttagaattctaacttgtctctgaccanatcaaccaaataacgaccccaaatcatcatttangatcgaccataacgcgcctcgtagggttcaactcgcttctcgtcgctacacgtctcggacaccgaccgcctccgtagactaactctcgtcggcctccgagtcgtagaggtacgngctagtactactacgtcgacgtgacttcattagtacgtacgtacgggttactagttacttcgttacgttcgttaccgtttacgggaacgttcgggtaacccgtaaacggttcccgtaaccgttaccgttaacggtaccgtaacggaccccgtaaaccgggacccccaaaaccccgttacgttcgtaccctttaacccg

SEQ ID NO: 417605 - DNA, 513 bp, Homo sapiens
  misc_feature: GZ8MTXP02I1BKS.19.78.H01.1.454.CMB.2.raw
  modified_base (412)..(412): a, c, t, g, unknown or other
  modified_base (414)..(414): a, c, t, g, unknown or other
  modified_base (439)..(439): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaagcccccaaactcatcatttatgatgccactaagcggccctcaggggtttctaatcgcttctctggctcaagtctggcacacggcctccctgacaatctctgggctccaggctgagacgaggctgatactacngntgcttacatactgcaggtctatctnttatgttctacggaactggaccaaggtctaccgtcctaggtcaacgcccaacggcccaaacccgctcgtctacc

SEQ ID NO: 417606 - DNA, 527 bp, Homo sapiens
  misc_feature: GZ8MTXP02GMWG9.19.78.H01.1.454.CMB.2.raw
  modified_base (264)..(264): a, c, t, g, unknown or other
  modified_base (436)..(436): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaaattctaactgtctctggtaccaanatcacccaaataaacgacccccaaactcatctatttatgatgaccaactaacgcggccctgtagggtttactaatcgtcttctcctgcctcaagtctggcacacgcctcctagacaatctcgtggcctccgagctgagacgacggctagattacacgtcgctgctacattangacaggtctatctcttatcgtcgttacggactggaaccaagtccaccgtcgagtcaacgcccaaacgtaccccaaaccctctcgtactacc

SEQ ID NO: 417607 - DNA, 752 bp, Homo sapiens
  misc_feature: GZ8MTXP02GH6IM.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaattctaacttgtctctgtaccaacatcaaccaaataacgaccccaaactcatctatttatgatcgaccaactaacgccggtccctacgtaacggggtttacctaaagttccgtacctttcctcccgtcggtaccctaccgtaaacggttcctacgggaccaaccgacccgggtacccccttaccccgtacgaacctaaacgttccgttacccgttcggggtcccttacccgacgggtaccgttagggaaccgggtaacggacggtaccgttaggtaactttaaccgtaacgtcggtccttcggtaccttacagttaagtcgtaccgtacgggttacttacttcttacgtttaagtcggttaccgtttaccggggtaaaaccgttacgggggtaaacccgtaaacggggttacccctaacccgggttacccgtaacggttacccgaaacccggaacccccgtaaaaccgggaccccctaaaacccccgtacgttccggtaccctttaaccccgg

SEQ ID NO: 417608 - DNA, 512 bp, Homo sapiens
  misc_feature: GZ8MTXP02IIJK4.19.78.H01.1.454.CMB.2.raw
  modified_base (262)..(262): a, c, t, g, unknown or other
  modified_base (317)..(317): a, c, t, g, unknown or other
  modified_base (358)..(358): a, c, t, g, unknown or other
  modified_base (434)..(434): a, c, t, g, unknown or other
  modified_base (438)..(438): a, c, t, g, unknown or other
  modified_base (511)..(511): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccanatcacccaaataaacgcccccaaaatcatcatttatgatgccataagcggccctnaggggtttctaaatcgcttctctggctccaagtctggcacncgcctccctgaccatctctgggctccagctagagacaggctgatactactgcttgcttcatatgcaggtctatctnttanggttcttacggaacttggggacctaaagggtcaaccggtcctaggtcaagcccaaggccaaacccctctcacnc

SEQ ID NO: 417609 - DNA, 534 bp, Homo sapiens
  misc_feature: GZ8MTXP02HA14A.19.78.H01.1.454.CMB.2.raw
  modified_base (519)..(519): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaagcccccaaactcaatcatttatgatgccactaagcgccctcaggggtttctaaatcgcttctcctgctcaagtctggcacacgcctcctgacaatctctggctccagctgaggacgaggctgattactactgcttgcttcatatgctaggtcgtatctcttatgtctttacggaacgttgggaaccaaaggtcctaaccgtcctaagggttccaacgacccgaacggacccaaaaccccnctacgtactaacccg

SEQ ID NO: 417610 - DNA, 509 bp, Homo sapiens
  misc_feature: GZ8MTXP02FHFGL.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacctgtctcctggtaccaacatcacccaaataaacgcccccaaactcatcatttatgatgccactaagcggccctcaggggtttctaatcgtcttctcctggctcaagtctggcacacgcctcctgacaatctctgggctcccaggctgaggacgaggctgattacactgctgctcatatgcaggtcgtatctctatgtcttcggaaactgggaccaaggtcaccgtcaggtcaagcccaaaggcccaaacccactcgtcacc

SEQ ID NO: 417611 - DNA, 600 bp, Homo sapiens
  misc_feature: GZ8MTXP02IBCBH.19.78.H01.1.454.CMB.2.raw
  modified_base (445)..(445): a, c, t, g, unknown or other
  modified_base (451)..(451): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgcctgactcagtctgcctccgtgtctgggtctcctggacagtcggtcaccatctcctgcactggaaccagcagtgatgttaggaaattctaaccttgtctctgtaccaacatcaaccaaataaacgccccaaactcactacatttactgatgaccactaacgcggtccctcgtagggtttctaaatcgtcttctctgcctacaagtctcggacacgaccggcctcctagacaactctctcgggcctcgaggctaggacgacgaggctgaacttactactgctgcttanacttancgagacggtcttaactctttattagtgttacgtttacgggaaacgttcggggaacctaaaacgggttcctaacccggttccgttaacgggacctaaacggacccccgaaacggaccccaaaaccccgtcgttacgttacccttaacccg

SEQ ID NO: 417612 - DNA, 578 bp, Homo sapiens
  misc_feature: GZ8MTXP02IXDQ6.19.78.H01.1.454.CMB.2.raw
  modified_base (355)..(355): a, c, t, g, unknown or other
  modified_base (363)..(363): a, c, t, g, unknown or other
  modified_base (373)..(373): a, c, t, g, unknown or other
  modified_base (389)..(389): a, c, t, g, unknown or other
  modified_base (408)..(408): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtacaacatcaccaaataacgaccccaaactcatcatttatgatgccactaagcggccctcgagggtttctaatcgcttctcctgctcagtctgcacncgcctccngacaatctcnggctcagctgagacgngctgattacactgctgctnactagtgactagggtacttactcgttactttagttcgttaccgttacgggtaaacgttacggggaaccctaaacgggttaccgtacccggttaccgttacggggttaccaaccggacccccgtaaaacggacccccaaacccccgtaccgttacgttaccccttaacccg

SEQ ID NO: 417613 - DNA, 574 bp, Homo sapiens
  misc_feature: GZ8MTXP02I6M21.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctgtacacatacaaccaaataacgaccccaaactcatactattatgatcgaccactaagccggaccctacgtagggttctaatcgtcttctcctcgctccaagtctggacacgaccgtcctacccgtagactaactctcgtcgggtcctccgagcgtagacggacgaggctagacttactactgctgctacgatatgacgtagtacgtatcgttcttagtgtacgttacggtaacgtacggtaaccgtaacggtcctaccgtaccgtacgtaccgaacgaccccgaaacgacccaacccgtacgtcgtacctacccg

SEQ ID NO: 417614 - DNA, 609 bp, Homo sapiens
  misc_feature: GZ8MTXP02G5MZI.19.78.H01.1.454.CMB.2.raw
  modified_base (460)..(460): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaattctaacttgtctctgtacacatcaccaataacgccccaaatcatcatttatgatgaccacgtaagccggccctcgtacggggtttctaaatccgtctttctccgtggctaccagtcgtggacaccgaccggtccctaccgtacgactaactctcgtcgggaccttccgaggccgtaggaacggacggacggtctacggtaacttacctaacgtcgtcgtntcctatatacgttcgacgtaggtcttagttcttacttacgttcgttacgttacggacggtttacgggaaccgtaaggttaccgtacccggtaccgtaggtaccgaaccgacccgaaccgggaccccaaccctaacgtccgtaactcccg

SEQ ID NO: 417615 - DNA, 626 bp, Homo sapiens
  misc_feature: GZ8MTXP02HSQIZ.19.78.H01.1.454.CMB.2.raw
  modified_base (267)..(267): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctgtaccaanatcaaccaaataacgccccaaactcatactatttatgatagcctaactaacgccggtacccttcgtaggggttttctaaagtcgtccttctccctggtcctaccaacgttctcggacaccgaccggccctacctcgactaactctcgtcggtctccgaggctggacggtacgaggtctagtaacttactactgtctcgtcttacattagtgcgtacgggttctattcttactttagtcgttcgttcgggaaaaccgttcgggaaaccgtaacggttacccgtaccggttaccgttacggtaccgaaccgtaccccgaaaccggtaccccaaccccgtacgtaccgttaccttaaccccg

SEQ ID NO: 417616 - DNA, 532 bp, Homo sapiens
  misc_feature: GZ8MTXP02GH2QL.19.78.H01.1.454.CMB.2.raw
  modified_base (263)..(263): a, c, t, g, unknown or other
  modified_base (278)..(278): a, c, t, g, unknown or other
  modified_base (390)..(390): a, c, t, g, unknown or other
  modified_base (438)..(438): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtggaaattctaacttgtctctgtaccanatcaccaaataaacnccccaaactcatctatttatgatgaccactaagcgccctgagggtttctaatcgcttctctgcctcaagtctgcacgcgcctccagacaatctctggctcgagctgagacgnggctagacttactactgctgcttcatagtgacgtagtcgtaattcgtnttatgtctacggaacgttcggaacctacggtcctacccgttacgtacggtaccaacgacccaacggaccccaaaccccgtctacgtacctaccg

SEQ ID NO: 417617 - DNA, 566 bp, Homo sapiens
  misc_feature: GZ8MTXP02HXH6A.19.78.H01.1.454.CMB.2.raw
  modified_base (352)..(352): a, c, t, g, unknown or other
  modified_base (364)..(364): a, c, t, g, unknown or other
  modified_base (388)..(388): a, c, t, g, unknown or other
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactgaaccagcagtgatgttaggaaattctaaccttgtctcctggtacaacactacaacccaaataaacgacccccaaactacatctaatttatgatcgccaactaacggccgaccctctagggttctaatcgcttcncctgctcagtcngcacacgcctcctagacactctcncggtctccgagctagaggacgaggtctagacttactactgctgctnatatcgagtacggtcttatcttactttaatcgttacgtttacggaacgttacggggaacctaaacggtcctaaccgtccgtaacggtaccaacgaacccaaccgggacccctaaacccgcgtactacacccg

SEQ ID NO: 417618 - DNA, 563 bp, Homo sapiens
  misc_feature: GZ8MTXP02G0WMV.19.78.H01.1.454.CMB.2.raw
  modified_base (379)..(379): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttaggaaattctaacttgtctcctgtacacatcaccaaataacgaccccaaactcatctatttatgatgaccactaacgccggccctacgtagggtttactaagtcgctttctcctggctcaagtctggacacgcggcctcccngactaatctctgggctccgagctaggacggacgagctagattacgtactgctgctcatatgacgtaggttcgtattcttacttagttcgtccgttacggaaacgttcgggaaacctacggttccaccgttccgtacggtcaaccgaccccgtaacggaccccaacccgtactcgtacctacccg

SEQ ID NO: 417619 - DNA, 509 bp, Homo sapiens
  misc_feature: GZ8MTXP02FZ3RM.19.78.H01.1.454.CMB.2.raw
  modified_base (357)..(357): a, c, t, g, unknown or other
  modified_base (419)..(419): a, c, t, g, unknown or other
  modified_base (500)..(500): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataaacgccccaaactcatcattatgatgccactaagcgccctcaggggtttctaatcgcttctcctggctcaagtctggcacncgcctccctgacaatctctgggctccagctggagacgaggctgattacactgctgctcatangcaggtacgtattcttcttatgtcttacggacttggaccaaggtcctaccgtcgtagtcaacgacccaacggcccaacccnctcgctacc

SEQ ID NO: 417620 - DNA, 537 bp, Homo sapiens
  misc_feature: GZ8MTXP02JPKYP.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcgccctcagggtttctaatcgcttctcctgctccaagtctggcacacggcctccctgacatctctgggctccgagctgaggacgaggctgattactactgctgctcatatgacgtaggtcgtatctcttatgtcgttacggaacgtgggaaccgtaacggtaccgaccgtaccgtacgtacgaacgacccgaaccggaccgaaccccacctcgtactacc

SEQ ID NO: 417621 - DNA, 562 bp, Homo sapiens
  misc_feature: GZ8MTXP02F40Z6.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccacatcaccaaataaacgacccccaaactcatcatttatgatgaccactaacgcggccctcgtacggggtttctaaatcgacttctcctgtcctacaagtctggcacgaccggccctcctcgactaatcctacgtcgggccttacccaggctggacggacgaggctgattactactgctgctcatatgcaggtcttatcttcttagtgttcttacggaacgttcgggaccaaggtaccacccgttacgtacggttaccaacgtacccgaaacggccccaacccgtactacgtacctacc

SEQ ID NO: 417622 - DNA, 521 bp, Homo sapiens
  misc_feature: GZ8MTXP02GYVKL.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctcctgtaccaacatcacccaaataaagcccccaaactcatcatttatgatgccactaagcggccctcaggggtttctaaatcgcttctcctgctcaagtctggcacacggcctccctgacatctctgggctccaggctgaggacgaggctagattacactgcttgctcatatgcaggtctatcttcttatgtctttacggaacgttgggacctaaggtctaccgtccgtaggtcaacgcccgaacggacccaacccactcgtactacc

SEQ ID NO: 417623 - DNA, 522 bp, Homo sapiens
  misc_feature: GZ8MTXP02I6125.19.78.H01.1.454.CMB.2.raw
  modified_base (382)..(382): a, c, t, g, unknown or other
  modified_base (508)..(508): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccacatcaccaaataaacgccccaaactcatctatttatgatgccactaacgcggccctcgtaggggtttactaatcgcttctcctgctccaagtctcggcacaccgcctcctgacaatcnctgggctccgagctgaggacgaggctagattactactgctgctcatatgcgaggtctatctcttatgtctcggacgtggactaaggtcctacgtaccgtagtcaacgacccgaacggcccaacccncgtacgtactaccg

SEQ ID NO: 417624 - DNA, 528 bp, Homo sapiens
  misc_feature: GZ8MTXP02F3EMT.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctggtaccaacatcacccaaataaagccccaaactcatcatttatgatgccactaagcggccctcaggggtttctaaatcgcttctcctggctcaagtctggcacacggcctccctgacaatctctgggctcccgaggctgaggacgaggctgattactactgcctagcttcattatgacctagggtctatcttgttaatgtcttacggactgggaaccaaggtccaccgtcctagtcaacgcccaacggacccaacccactcgtactaccg

SEQ ID NO: 417625 - DNA, 632 bp, Homo sapiens
  misc_feature: GZ8MTXP02IKCSL.19.78.H01.1.454.CMB.2.raw
  modified_base (296)..(296): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgaccacatcaaccaaataacgccccaaatcatactattanagatcgaccactaagccgtaccctcgtacgggtttcaaatcgtcttactccgtcgtacctacctaagttcgtacggacaccgaccgtccctacccgtagtaacctactccttacgcggtcctaccgaggcgtaggacggaccggaggtccttaggtaaacctttaccgtacgtcgtccttacgtaccttacaagttacgtcgtacgtaacgggtttcttaactcgtttactttagtcgttacgttacggaaacgttcgggaaacctaaggtccaccgttacgtacgtaccaaccgcccgaaacggtaccccaaacccgtctaccgtacctaacccg

SEQ ID NO: 417626 - DNA, 535 bp, Homo sapiens
  misc_feature: GZ8MTXP02G0YY6.19.78.H01.1.454.CMB.2.raw
  modified_base (225)..(225): a, c, t, g, unknown or other
  modified_base (423)..(423): a, c, t, g, unknown or other
  modified_base (438)..(438): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaacttgtctctgtaccacatcaccaaataacgccccaaactcatcatttatgatgaccactaagcggccctcgtaggggttctaatcgcttctcctgctcaagtctggcacacggcctcctagacaatctacgtggctccgaggctggagacgaggctagatactactgctgctcatntgcaggtcgtatctnttatcgtcgttacggacgttcgggaacctaaggtaccacccgttacgtacgtacgaacgacccgaacggaccccaaacccgtacgtcgtactacccg

SEQ ID NO: 417627 - DNA, 531 bp, Homo sapiens
  misc_feature: GZ8MTXP02G4NT2.19.78.H01.1.454.CMB.2.raw
  modified_base (233)..(233): a, c, t, g, unknown or other
  modified_base (409)..(409): a, c, t, g, unknown or other
  modified_base (433)..(433): a, c, t, g, unknown or other
  modified_base (442)..(442): a, c, t, g, unknown or other
  modified_base (521)..(521): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtnatgttgaattctaacttgtctctgtacacatcaaccaaataacgaccccaaactcaatcatttatgatgaccaactaagccggccctcgtagggtttctaatcgcttctcctgctaccaagtctaggacacgaccgtcctacctgaccaatctcgtggcctcgagctagaggacgnggctagattactactgtctgtctnaatgtacgngtagggtactatcttcttagtcgtcttacggacgtggaccgaagtcaccgtcgtagtcaacgaccaacggccaaccccngtactctacc

SEQ ID NO: 417628 - DNA, 552 bp, Homo sapiens
  misc_feature: GZ8MTXP02JSTD6.19.78.H01.1.454.CMB.2.raw
  modified_base (376)..(376): a, c, t, g, unknown or other
  modified_base (446)..(446): a, c, t, g, unknown or other
  modified_base (450)..(450): a, c, t, g, unknown or other
  modified_base (463)..(463): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccaacatcaacccaaataaaacgcccccaaaactcaactctaatttatgatgaccaactaagccggccctcgtaggggtttctaaatcgctttctcctgctcaagtctggcacncggcctcctagacaatctcgtcgggctccgaggctggaggacgacggctagtacttactactggctgctnatangcaggtctatctnttatgtcttacggaacgtcgggaaccaagggtcctaccgtcgtacgtacgaacgaccccgaacggacccaaccctacgtctactacccg

SEQ ID NO: 417629 - DNA, 517 bp, Homo sapiens
  misc_feature: GZ8MTXP02FGG0Z.19.78.H01.1.454.CMB.2.raw
  modified_base (344)..(344): a, c, t, g, unknown or other
  modified_base (428)..(428): a, c, t, g, unknown or other
  modified_base (442)..(442): a, c, t, g, unknown or other
tcagtactctcgtgcacgaccggtgctcgatttagtgtgagtagtttgggtttggggttcacaagaggcagcgctctcgggacgtctccaccatggcctgggctctgctgctcctcactctcctcactcaggacacagggtcctgggcccagtctgcccctgactcagtctgcctccgtgtctgggtctcctggacagtcggtcaccatctcctgcactggaaccagcagtgatgttggaaattctaacctgtctcctggtaccaacatcacccaaataaacgcccccaaaactcatcatttatgatgccactaagcggccctcaggggtttctaatcgcttcncctggctccaagtctggcacacggcctcctgacaatctctgggctccaggctgaggacaggctgattactctgctagctcattntgcaggtctatctnttatcgtcgtacggacgtcggaaccaaggtccaccgtctagaccaacgacccaacggcccaacccactctacacg

SEQ ID NO: 417630 - DNA, 548 bp, Homo sapiens
  misc_feature: GZ8MTXP02JY7NQ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatacacccaaataaacgcccccaaactcatcatttatgatgaccactaagccggccctcgtaggggtttctaaatcgcttctcctggctccaagtctggcacacggccctccctgacaatctcgtgggcctccgaggctggaggacgaggctgattactactgctgctcatatgcgtaggtcttatcttactttatcgttcgttacggaacgttcgggaacctaaaggtccaccgtcctaggtccaacgcccgaaacggcccaaccccgctcgtacctacc

SEQ ID NO: 417631 - DNA, 522 bp, Homo sapiens
  misc_feature: GZ8MTXP02G4MEQ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgacccccaaactcatacatttatgatgccactaagcgccctcaggggtttctaatcgcttctcctgctccaagtctggcacacgcctcctgacaatctctgggctccgagctggagacgaggctgtacttactactgctgcttcatactgcagggtctatcttcttatgtcttacggactggacctaaaggtcaaccgtcctaggtcaacgacccaacggcccaaccccactcgtctacc

SEQ ID NO: 417632 - DNA, 574 bp, Homo sapiens
  misc_feature: GZ8MTXP02IWI31.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctactgtctctgacacatcaccaaataacaccccaaatcatctattatgatcgaccactaacgccggccctcgaggggttttactaatcgtcttctcctcgctcaagtctggcacgccgcctcctgactaatctcgtggctcgagctgaagacgaggctagtattactactgctgctacatacgtagcgagggttactacttcttactttagtcgttacgttacgggaaaacgttcggggaaccgtaaacgggttaccacccggttacgtacggtaccgaacgtaccccggaaacggacccctaaaccccgtacgttccgttacctaacccg

SEQ ID NO: 417633 - DNA, 593 bp, Homo sapiens
  misc_feature: GZ8MTXP02JUO54.19.78.H01.1.454.CMB.2.raw
  modified_base (252)..(252): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttntctctgtacacatcaaccaataacaccccaaactcatactaattatgatcgaccactaagccggtccctacgtagggttactaatcgtcttctcctgctcagtctcgacacgacgcctccgtagacaactctcgcggtcctcgacgcgtaggacggacgacggactagtaattactactgctagctacatagtgacgtggtacttattcttactttacgtcgttaccgtttacggaaaccgtacggggtaccctaaacgggttccctacccggttaccgtaacggtccgaaccggaccccgaaaccggccccaaacccgtaccgttaccgacctttacccg

SEQ ID NO: 417634 - DNA, 506 bp, Homo sapiens
  misc_feature: GZ8MTXP02GNIH9.19.78.H01.1.454.CMB.2.raw
  modified_base (359)..(359): a, c, t, g, unknown or other
  modified_base (423)..(423): a, c, t, g, unknown or other
  modified_base (426)..(426): a, c, t, g, unknown or other
  modified_base (431)..(431): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgtgaaattctaacttgtctctggtaccaacatcaaccaaataaacgcccccaaaactcatcaatttatgatgaccaataagcgccctcaggggtttctaaatcgcttctctggctcgagtctggcacncggcctccctagacaatctctcgggctccgaggctgaggacgaggctgattacactgctgctanatngacgngtctatctatatgtcgtacgacgtggactagtccaccgtactacgacaacgaccgaacgacccaccactctacac

SEQ ID NO: 417635 - DNA, 572 bp, Homo sapiens
  misc_feature: GZ8MTXP02GVX6E.19.78.H01.1.454.CMB.2.raw
  modified_base (226)..(226): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccngcagtgatgtgaaattctaacttgtctctgtacaacatcaccaaataacgaccccaaactcatcatttatgatgaccactaagcgccctgtagggtttcaatcgtcttctcctgctaccaagtctacggacaccgaccggccctccctagaaccaactctcgtacgggcctccgaggctaggacgacgagctagtattactactgctgctcatatgaccgtaggtacttatcttattagttcgttccgttacggaacgtacggggaacctaacggtacctacccgttaccgtaacggtaccgaacgaccccgaaacggaccccaaacccgacgtcgtactaacccg

SEQ ID NO: 417636 - DNA, 684 bp, Homo sapiens
  misc_feature: GZ8MTXP02HPWWN.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaattctaactgtctctgtacacatacaaccaaataaacgccccaaactcatctatttatgatcgaccaactaacgccggtccctacgtacgggtttactaagttccgtaccttctcctcggtcctaccgaacgttctcggacaccgaccggtccctacctacgtaactaactccttacgtcgggtcctacccggaggtccgtagggaaacggaacgggacggtacgttacggtaactttaccgtaacgttcggtaccttcggtaccttacgtaacttacgtcggtaccgtacgggtttacgtacgttacctttacgtttacgttcggtttacccgttaccgggtaaaacggttcgggtaaacccgtaacgggttaccctaacccggtaccgttaacggtaccaaccgaccccgtaaccggaccccaaccctactccgtacttacccg

SEQ ID NO: 417637 - DNA, 633 bp, Homo sapiens
  misc_feature: GZ8MTXP02JQNTS.19.78.H01.1.454.CMB.2.raw
  modified_base (225)..(225): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttagaaattctaacttgtctctgtacacatcaccaaataacgaccccaaactcatactatttatgactcgaccaacgtaaacgccggtaccctacgtaggggtttactaaacgtccgtcttctccgtcgcctactaacgtctacggaccaccgaccggcctaccctagacctaattcctcgtcgggacctcccgaggtcgtaggaacgggacgacggtctagtatacgtactggctcgtactacattgtcgacgtaacggtcgtacttcgttactttagtcgttccgttaacgggtaccgttacggggaaacccgtaacggtcccgtaacccggttcctaacggggttccaacgaccccggaaaccggacccctaacccgtacttacggaccttacccg

SEQ ID NO: 417638 - DNA, 514 bp, Homo sapiens
  misc_feature: GZ8MTXP02F3IG0.19.78.H01.1.454.CMB.2.raw
  modified_base (223)..(223): a, c, t, g, unknown or other
  modified_base (401)..(401): a, c, t, g, unknown or other
  modified_base (503)..(503): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctctgcactggaaccngcagtgatgtagaaattctaactgtctctggtacacatcaccaaataaacgaccccaaactcaatcattatgatgaccactaagcggccctcaggggtttctaatcgcttctcctggcctacaagtctggcacgacggccctccgtgaccaatctactgggctcccgagctgagacgngctgattactactgactgctcatatgacgagtcgtacttctcttatcgtcttacggacttgggaaccaaggtcaccgtcaggtcaacgccaacgcccaaccnctacgtctacc

SEQ ID NO: 417639 - DNA, 610 bp, Homo sapiens
  misc_feature: GZ8MTXP02IGDJC.19.78.H01.1.454.CMB.2.raw
  modified_base (338)..(338): a, c, t, g, unknown or other
  modified_base (414)..(414): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtacaacatcaccaaataaacgaccccaaactcatcatttatcgatcgaccactaacgccggccctcgtaggggtttctaagtccgtcttctctggctaccaagtctggcaacncggccctcctgactaatcctcgtggctccgaggctggcggacgaggctgtacttactacgtgctgcctacagttancgtagaacggttcgtaacttcttacttagttcgttccgttacggaacgtacgggtaccgtaacgggtaccacccgttccgtacgtaccgaacgtaccccgaaacggaccccaaaccccgtactacgtccaacgttccgtcccgttccccgccccttccgtaccgaacgacgtacgtacgtggacggtcgcgtacgg

SEQ ID NO: 417640 - DNA, 538 bp, Homo sapiens
  misc_feature: GZ8MTXP02I2U6S.19.78.H01.1.454.CMB.2.raw
  modified_base (232)..(232): a, c, t, g, unknown or other
  modified_base (253)..(253): a, c, t, g, unknown or other
  modified_base (260)..(260): a, c, t, g, unknown or other
  modified_base (275)..(275): a, c, t, g, unknown or other
  modified_base (283)..(283): a, c, t, g, unknown or other
  modified_base (293)..(293): a, c, t, g, unknown or other
  modified_base (296)..(296): a, c, t, g, unknown or other
  modified_base (335)..(335): a, c, t, g, unknown or other
  modified_base (353)..(353): a, c, t, g, unknown or other
  modified_base (361)..(361): a, c, t, g, unknown or other
  modified_base (368)..(368): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcactggaaccagcagtnatgttagaattctaactgtcnctgacanatcaaccaaataacnccccaaancatctattangancgacacaagccgtccgtcggggttctactcgtcttctcncgctcaagtctgacaacncgcctccngacatcncgtggctacgagctggagacgagctagtaactactcgtgtctgctactatagtcgacgtacggttactacgttcttcttagtcgtcgttacggaacgtagggtaaccacggtaccaaccgtcgtacgtcgacggaaccaacggaccccacccactcgtactacgtacccg

SEQ ID NO: 417641 - DNA, 638 bp, Homo sapiens
  misc_feature: GZ8MTXP02JQ67Y.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatacaccaaataacgccccaaactcatacatttatgatcgaccaactaagcggccctacgtagggttctaatcgcttctctgctacaagtctggacacgaccggtcctcccgtagaccaactctacgtgggcctccgaggctaggacggacgacgggctaggtaactttacctaacgtcgtccttacgctacgtaatagtgacgtacggggttacttacttcttacgtttagttcggttacgtttaccggaacggtttacggggaaacccgtaaacgggttcccgtaaccccggtcccgttaacggttacccgaaccggtaacccccggaaacggaccccctaaaacccctccgttaccggtaccttaccccg

SEQ ID NO: 417642 - DNA, 597 bp, Homo sapiens
  misc_feature: GZ8MTXP02GUTOX.19.78.H01.1.454.CMB.2.raw
  modified_base (225)..(225): a, c, t, g, unknown or other
  modified_base (277)..(277): a, c, t, g, unknown or other
  modified_base (407)..(407): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaacttgtctctgtacacatcaaccaaataaacnccccaaactcatcatttatgatcgccactaagccggccctgtaggggtttctaatcgcttctcctgctcagtctggacaccgaccggcctccctagacaactctcgtcgggcctccgaggctggagacgnggctagtattactactgtctagctcatagtcgcgtaggtcgttattcttactttagtcgttccgttaacgggtaacgtcggggaaacccgtaacggttcccgtaacccgttaccgtaacgggttaccaaccggaacccccgaaaacggtaccccctaaacccccgtacgttacccgtacctttaaccccg

SEQ ID NO: 417643 - DNA, 571 bp, Homo sapiens
  misc_feature: GZ8MTXP02G94JI.19.78.H01.1.454.CMB.2.raw
  modified_base (265)..(265): a, c, t, g, unknown or other
  modified_base (454)..(454): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctacttgtctcctgtaccanatcaccaaataacaccccaaactcatactatttatgatgaccaactaacgcgccctcgtacgggtttactaatcgcttctctcgcctaccaagtctggacaccgaccgccctccctagacaatctacgtgggcctaccgagtcgtaggacggacgaggctaggtacttactacgtcgctgctacattcngcaggtctatcgttcttatcgttcttacggacgttacgggaaccgtaacggtcctaccgtaccgtacggtaccgaacgaccccgaacggcccctaaaccctcgtactaccttacccg

SEQ ID NO: 417644 - DNA, 630 bp, Homo sapiens
  misc_feature: GZ8MTXP02HWR9S.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctctgcactggaaccagcagtgatgttagaaattctaacttgtctcctgtaccaacatacaaccaaataaacgaccccaaactcatcatttatgatacgcctactaacgccgccctacgtagggtttacaatcgcttctctgctaccaagtctaggcacgaccggccctcctacgaaccaacgtctccgtggtcctccgagcgtgaacggacgaggctagacttacgtactgtctcgcttacattagtcgacgtaggtacgttattcttacctttatcgttaccgtttacgggtaaaaccggttcgggaaaccgtaaacggttacccgtacccggtttacccgtaacgggttaccaaaccggacccccgaaaacgggaccccccaaaacccccgtaacctttcggttaacccttaaccccg

SEQ ID NO: 417645 - DNA, 579 bp, Homo sapiens
  misc_feature: GZ8MTXP02JVS1N.19.78.H01.1.454.CMB.2.raw
  modified_base (363)..(363): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaaccaaataaacgcccccaaatcatcattatgatgcactaagcgccctcgagggtttctaatcgcttctctggctccaagtctggcaacaccggcctcctgacaatccctcgtggctccaggctgnggacgaggctgattactactgctgctcatatgcgtagtcgttatcttctttatcgttcgttacggaacgttcggggaccaacgggtacctacccgtaccgtacggtaccacgaccccgaacggacccaaaccccgtctacgtaccacttcctaccgttaccccacccctaccctacccgaacgacgtaacgttcgacgacggtccggaccgtcggg

SEQ ID NO: 417646 - DNA, 544 bp, Homo sapiens
  misc_feature: GZ8MTXP02IZZS9.19.78.H01.1.454.CMB.2.raw
  modified_base (364)..(364): a, c, t, g, unknown or other
  modified_base (394)..(394): a, c, t, g, unknown or other
  modified_base (407)..(407): a, c, t, g, unknown or other
  modified_base (416)..(416): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttgaaattctaacttgtctctgtacacatcaccaaataacgcccccaaatcatcatttatgatgaccactaagccgccctacgtagggtttctaatcgtcttctcctgctacagtctggacacgcgcctccngacatctctcggctcgagcgtgacggacgnggctagacttacntagctgctnatgtgcgtagtcgtatcttacttagtcgttacgttacggaacgtggggaacctaacggtcctacccggttcctaaggttccaaccggacccgaacggaccccctaaacccgtccgtcgtacctacccg

SEQ ID NO: 417647 - DNA, 525 bp, Homo sapiens
  misc_feature: GZ8MTXP02G1E0J.19.78.H01.1.454.CMB.2.raw
  modified_base (298)..(298): a, c, t, g, unknown or other
  modified_base (418)..(418): a, c, t, g, unknown or other
tcagtactctcgtgcacgaccggtgctcgatttagtgtgagtagtttgggtttgggctcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctggtaccaacatcacccaaataaacgcccccaaatcatcatttangatgccataagcggccctcagggtttctaatcgcttcctctgctcaagtctggcacacggcctcctgacaatctctgggctccgagctgaggacgaggctgattactatgctgctcatangcaggtcgtatcttacttatgttacgttcggattacgggaccaaacggtccaacccgttcctaggtccgaacgcccgaaaacggccccaaaaccccacgtcgtaccc

SEQ ID NO: 417648 - DNA, 533 bp, Homo sapiens
  misc_feature: GZ8MTXP02G221F.19.78.H01.1.454.CMB.2.raw
  modified_base (197)..(197): a, c, t, g, unknown or other
  modified_base (226)..(226): a, c, t, g, unknown or other
  modified_base (337)..(337): a, c, t, g, unknown or other
  modified_base (358)..(358): a, c, t, g, unknown or other
  modified_base (424)..(424): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatctcctgcactggaaccngcagtgatgttgaaattctaacttgtctctgtaccaacatcacccaaataacgcccccaaatcatcatttatgatgccataagcggccctctagggtttctaatcgcttcncctggctccaagtctggcacncgcctcctagacaatctacgtgggctccgaggctgacggacagggctgacttactactgcctgctnatgtgcaggtcgtatcgttcttatcgtctttacggacttcggggaccaaacggtcacccgttctacggtcaacggaccccaacggccccaacccacgtcgtactacccg

SEQ ID NO: 417649 - DNA, 698 bp, Homo sapiens
  misc_feature: GZ8MTXP02JYHOT.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaacttgtctctgtaccacatcaaccaaataacgaccccaaactcatctaatttatgatcgacctactaacgccgtcccgtcgtacgggtttctaactcgtcttctcctgctaccaagttctcggacctaccgaccggtccctaccctagacctaaacttccgtccgtcggggtcctacccggaggtccgtaggacgggacgacgggtccttaggtacttactacgtcggtccttcggtctactagttacgttcgcgttaacgggttcgttaacgttctttactttagttcgttccgtttaccgggtaaacgttaccggggtaaaccccgtaaacggttacccgtaaccccggttacccggttaacggtaccccgtaacccggaaccccccggtaaaaccggggaacccccctaaacccccgtaaccgttccgggtaacccctttacccccgg

SEQ ID NO: 417650 - DNA, 650 bp, Homo sapiens
  misc_feature: GZ8MTXP02FWRLL.19.78.H01.1.454.CMB.2.raw
  modified_base (262)..(262): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaactgtctctgtaccanatacaccaaataacgaccccaaactcatctattatgatgaccaacgtaacgccggaccctcgtaggggttttactaatcgtcttactcctcggtcctacgaacgttcgtacggaccaaccgaccggcccttacccgttacgaaacctaaacttccgtacgtcgggtacctacccgtagaccgtaggaacgggaccgaggtcgtacgtaattacctacgtgcgtcgactctataacgtcgtacgtaggttctaacttcttacgttagttacgttacgttacggtaacgttacgggaacccgtaaaggttccgtaacccgttacgtaacggtccgaaccggaaccccgtaaacggaccccctaaaaccctacggtccgtaccttaacccg

SEQ ID NO: 417651 - DNA, 527 bp, Homo sapiens
  misc_feature: GZ8MTXP02JHS1R.19.78.H01.1.454.CMB.2.raw
  modified_base (518)..(518): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcacccaaataaacgcccccaaactcaatcatttatgatgccactaagcggccctcgtaggggtttctaatcgcttctcctgctcaagtctggcacacggcctcctgacaatctctcgggctccgaggctggagggtacgaggctagtattactacgtgctgctcatagtgctaggtctatcttcttattcgtcttacggacttcgggaaccaggtccaccgtccgtagtccaacgccgaacggcccaacccnctcgctacc

SEQ ID NO: 417652 - DNA, 709 bp, Homo sapiens
  misc_feature: GZ8MTXP02HQBVX.19.78.H01.1.454.CMB.2.raw
  modified_base (220)..(220): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcacatctcctgcactgaaccngcagtgatgttagaaattctaaccttgtctctgtaccaacactaccaacccaaaataacgacccccaaactcaactactaatttactgtatcgaccactaacgcgtccctagtaggggtttactaaatcgtacttctccgtcgtcctacctaagtcgtacggacaccgaccggtcctcccgtagaaacctaacgtccttccgtcgggtacccttacccggacgggtccgttagggaaacgggaccggaacggtcccgttagtaactttacctaacgtcggtaccttacggctttaccaattacgtgacgttaacgggttccgttaatttccttagtttaacttcggttaaccgtttacggggaaaaccgttcggggtaaacccgtaaacgggttaccctaacccggttccccgtaagggttacccgaaccgtacccccgaaaaccggcccccaaaaaccccggtaccgttccgttaacccttaaccccg

SEQ ID NO: 417653 - DNA, 507 bp, Homo sapiens
  misc_feature: GZ8MTXP02FINU2.19.78.H01.1.454.CMB.2.raw
  modified_base (301)..(301): a, c, t, g, unknown or other
  modified_base (426)..(426): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaagcccccaaactcatcatttangatgccactaagcgccctcaggggtttctaatcgcttctcctgctcaagtctggcacacggcctccctgacaatctctgggctcccaggctgaggacgaggctgattacacttgctgctcatacngcaggtctatctcttatgtcttcggaactcgggacaggtcaccgtctagtcaagcccaacggccaaacccgctcgtcaacg

SEQ ID NO: 417654 - DNA, 691 bp, Homo sapiens
  misc_feature: GZ8MTXP02J0SG1.19.78.H01.1.454.CMB.2.raw
  modified_base (299)..(299): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaattctaacttgtctctgtaccacatcaaccaaataacgaccccaaactcatctatttangatcgccactaagccggccctcgtagggtttctaatccgtcttctccgtcgctacctaagtctaggaccaccgaccgggtccccttacccgtagaacctaaacttccgtcgtcggggtcccttaccgacgggtacgtagggaaacgggacggacggtccttaggtaactttaccgtacgttcgcttcgacttacgtaatacgtcgacgtacgggttacttaacttcttaccgtttaagtcgtttaccggtttacgggtaaaccggttacggggaaaccccgttaaaacgggttccccgtaaacccggtttcccgttaaacggggtaccctaaccgggtacccccgaaacggtacccccctaaaaccccgtccgtttaccgtacccttacccg

SEQ ID NO: 417655 - DNA, 578 bp, Homo sapiens
  misc_feature: GZ8MTXP02GG7K9.19.78.H01.1.454.CMB.2.raw
  modified_base (360)..(360): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacttgtctcctgtaccaacatcaaccaaataaacgccccaaactcatcatttatgatgccactaagcggccctcgtagggtttctaatcgcttctcctgctcaagtctgacacncgcctcctgacatctctggctccagctggaacggacgaggctagtacttacgtactgctgcttacattagtcgacgagggttctacttcgtactttatcggttccttacgggtaactaggggaaccctaaaggtccctaacccgttcccgtaagggttaccaaccggacccccgaaaacggaccccctaaaccccgtacgtacggtaccctaaccccg

SEQ ID NO: 417656 - DNA, 589 bp, Homo sapiens
  misc_feature: GZ8MTXP02F8RNS.19.78.H01.1.454.CMB.2.raw
  modified_base (263)..(263): a, c, t, g, unknown or other
  modified_base (278)..(278): a, c, t, g, unknown or other
  modified_base (296)..(296): a, c, t, g, unknown or other
  modified_base (429)..(429): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacgagggtcctgggcccagtctgccctgactcagtctgcctccgtgtcgtggtctccgtggacagtcgtcaccatctcctgcactggaaccagcagtgatgtagaaattctaactgtctctgtaccanatcaccaaataaacnccccaaatcatcatttangatgccactaagcgccctcgagggtttctaatcgtcttctctgctcaagtctgcacgacgcctcctagacaaatctctgggcctccagtctgaaggaccgaggtctagtaacttactacgtgcctgtccctanattaagtgaccgaggttcttaatccttattaagtcgttacgttacgggtaaccgtacgggaaaccgtaaaggttccccgtaccgttacccgtttacggaccgaaccgaccccgaaaacggtaaccccccaaaccccctaggttacccgtacttaaccccg

SEQ ID NO: 417657 - DNA, 590 bp, Homo sapiens
  misc_feature: GZ8MTXP02GJKIU.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcactggaaccagcagtgatgtaggaaattctaaccttgtctcctggtaccaacatacaccaaataaacaccccaaactcatactatttatgatgaccaataagccgccctcgtaggggtttctaatcgtcttctcctgcctacaagtctgacacaccggcctccctagactaatctacgtgggcctcgagctaggagacgaggcagtattacacgtgtctgtctcatagtagacgtacgtacgttactcttacttagttcgttacgttacgggtaacgtacggggtaaaccgtaacggttaccgtacccgttacgtaacggtaccgaaccgacccgaacggaccccctaaacccctacggtaccgtactttaaccc

SEQ ID NO: 417658 - DNA, 604 bp, Homo sapiens
  misc_feature: GZ8MTXP02JHM9J.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctctggtaccaacatcacccaaataaacgccccaaactcatctactttatgatgccactaaagccggtaccctcgtaaggggtttctaaagtcgtcttctcctggctccaagtctaggacacgaccgcctccctagacaactctcgtgggctcccaggctggagacgaggctagattactactgcttgcttcatatgcgagtcgtatcgttacttagtcgttccgttacggaaaacgtggggtaacccctaaaagggtttcccgacccggttaccgttaacgggttacctaaccgacccccgtaaaaaggggcccccaaaaacccccttacgttcggtacccttaacccg

SEQ ID NO: 417659 - DNA, 554 bp, Homo sapiens
  misc_feature: GZ8MTXP02IHW30.19.78.H01.1.454.CMB.2.raw
  modified_base (262)..(262): a, c, t, g, unknown or other
  modified_base (333)..(333): a, c, t, g, unknown or other
  modified_base (351)..(351): a, c, t, g, unknown or other
  modified_base (369)..(369): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacaanatcaccaaataaacgccccaaatcatcattatgatcgccataagcgccctgtagggtttctaatcgcttcnctgcctcaagtctgcacncgctccctagacatctcnggctccagctgaagacgacggtactgattaactcgtcgactgctacaattgtcgactagggttctaacttcttacttatacggttcttacggaaacgttacgggaaccctaaagggtccctaaccgttccgtacggtaccaacgacccgaacggtaccccaaaaccctcgtcgttaacgtaaccc

SEQ ID NO: 417660 - DNA, 598 bp, Homo sapiens
  misc_feature: GZ8MTXP02IW7B5.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctgtacaacatacaaccaaataacgaccccaaatcatctatttatgatcgaccacgtaacgccggccctcgtagggtttctaatcgcttctcctgctcaagtctaggaccacgaccggccctccctagtaacctaactcctcgtcgggcctaccgaggctaggaggacgaggtcttagtaacttactacgtggcttgccttatactagtcgacgtaaggttcgttattcttctttagtcgttcgttacggacgttacgggaaccgtacggtacctaccgttaccgtacggtaccgaaccgaccccgtaacggacccccaacccgtacgttcgtaccttacccg

SEQ ID NO: 417661 - DNA, 622 bp, Homo sapiens
  misc_feature: GZ8MTXP02G7LTM.19.78.H01.1.454.CMB.2.raw
  modified_base (223)..(223): a, c, t, g, unknown or other
  modified_base (245)..(245): a, c, t, g, unknown or other
  modified_base (256)..(256): a, c, t, g, unknown or other
  modified_base (270)..(270): a, c, t, g, unknown or other
  modified_base (290)..(290): a, c, t, g, unknown or other
  modified_base (321)..(321): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctccgtgacagtcggtcaccatctcctgcactgaaccngcagtgatgtagaattctactntctctgtacanatcaccaaataacnccccaatcatcattatgatncactagcgtccctgtaggttcaatcgcttcncctgctcagtcagcacgcgcctctgactatctcgtcggctacgaggcgtagacggacgacggtcttacgtattactacttacggtcttcgaccttaagtagttacgtacggtaccgtagggtttaccgttaatccctttagtttacggttaccgttaccggtttaacgggtaaaccggtttaaacgggggaaacccttaaacgggttaccccgtaacccgtttaccggaccggttaccgaacccggttaaccccgaaaccggtaccccctaaaacccgtacggttccgtaccttaaccccg

SEQ ID NO: 417662 - DNA, 724 bp, Homo sapiens
  misc_feature: GZ8MTXP02HHHX7.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttagtaaattctaaccttgtctctgtaccaacataccaccaaataacacccccaaactcactctatttatgatcgaccacgtaaacgccggtaccccttacggtaaggggttttctaaacgttccgtcttttccgtccgtacggtccttaccgtaacgttcgtcggacctaccgaccggtccccttaccctacgaacctaacgtcgtccgtcggggtctacccgaggcgtacggaggggaccgaggtcctaggtaaactttcgacgttcggtcttcggcttactaagttgtacggtacgtacggggttcttacttactttaccgtttagtttacggttaccccgtttacgggaaaccggttacggggtaaacccgtaaaacgggttccccgtaacccggtttacccggttaagggtaccccgaaccggttacccccgaaaaccgggacccccctaaaaccccgtccgggttacgttacccctttaacccgg

SEQ ID NO: 417663 - DNA, 787 bp, Homo sapiens
  misc_feature: GZ8MTXP02JBT6U.19.78.H01.1.454.CMB.2.raw
  modified_base (225)..(225): a, c, t, g, unknown or other
  modified_base (274)..(274): a, c, t, g, unknown or other
  modified_base (278)..(278): a, c, t, g, unknown or other
  modified_base (290)..(290): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcactggaaccngcagtgatgttagaaattctaacttgtctctgtacacatacaaccaaanaacnccccaaatcatntaattatgatcgaccaactaacgccggcccttacggtacgggtttactaacgttccgtactttcctcccgtcggtacccttaccgtaaacggttccgtacggaaccctaacccggtacccgggtacccccttccccgtaacgtaaacctaaacgtttccgttaccggtccggggtcccttacccggagggtaccgttacgggaacggggaaccgtacggggtacttacggtaactttaaccgtacgttcggtaccttcgaccgttactaaacgttcgtacggtaccgttaacgggttacctttacgtttacctttacgtttaacgtttcgggttaacccggtttaaccggggaaaccggttccgggggtaaaaccccgtaaccggttaacccgtaccccggtttaccggtaacggttacccgaaacccggtaacccccgtaaaacccgggtaccccctaaaacccccgtaccgtttacccggttaaacccttccccg

SEQ ID NO: 417664 - DNA, 522 bp, Homo sapiens
  misc_feature: GZ8MTXP02F74NK.19.78.H01.1.454.CMB.2.raw
  modified_base (437)..(437): a, c, t, g, unknown or other
  modified_base (445)..(445): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctggtacaacatcaccaaataaacgaccccaaactcatcatttatgatgccactaacgcggccctcgtaggggtttactaatcgtcttctcctcggctacaagtctcggacacgacggccctcctgacaatctctcgggctcgagctggacggacgaggctgtattactacgtgctgctnactatgcnggtctatcttcttatgtcttacgactggacagtcacgtctagtcaacgccgaacgacccaacccgactcgctacccg

SEQ ID NO: 417665 - DNA, 707 bp, Homo sapiens
  misc_feature: GZ8MTXP02I7O6X.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctacttgtctctgtaccacatacaccaaataacgaccccaaatcatcatttatgatcgacctactaaagccggaccctacgtagggtttctaaatcgtcttctctagcctcaacgtctaggcacgaccggcctacctagactaactctcgtacgcctaccgagctaggacggacgacggtcgtagtaacttaactcgtacggcttacggcccttataaattacgtacggtaccgtaacggggttaccgtttaatttcccgtttacgtttaaacgtttcgggtttaaccggtttaacccgggttaaaaccggttaccgggggtaaaaccccgttaaacgggttacccgtacccccgggtttaaccggtttaacggggtaacccgtaaaacccgggtaacccccgaaaacccgggtacccccgaaaaaccccctaccgtttacccgggaaccctttaaacccccg

SEQ ID NO: 417666 - DNA, 547 bp, Homo sapiens
  misc_feature: GZ8MTXP02IX0DN.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctctgtaccaacatcaccaaataaacgaccccaaactcatcattatgatgccataagcgccctgagggtttctaatcgtcttctctggctacaagtctggcacgacggtccctccctagaccaatcctcgtcggggctccgaggctggaggacgaggctagtattactactgctgctcatatgcgtaggttctatcgttcttatcgttcttacggacttaggggaacctaaacggttccacccgttcgtacggtccaacgacccaacggccccaacccgactcgtactaccc

SEQ ID NO: 417667 - DNA, 571 bp, Homo sapiens
  misc_feature: GZ8MTXP02FKXYR.19.78.H01.1.454.CMB.2.raw
  modified_base (301)..(301): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataacaccccaaactcatactatttatgatnccaactaacgccggccctcgtaggggtttctaaatcgtcttctcctcggtctaccgaaacgtctcggacctacgaccggccctaccctagaactaatcctcgtcgggcctcccgaggctggaggacgacggtctgtaattactactgctgctacgatagtgactaggtcgttactcttcttatgttcgttacggtaacgtcggaaccaaggtccaccgtaccgtacggtacaacgacccgaacggacccaaaccctcgacctacctaccg

SEQ ID NO: 417668 - DNA, 554 bp, Homo sapiens
  misc_feature: GZ8MTXP02IGSDY.19.78.H01.1.454.CMB.2.raw
  modified_base (432)..(432): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcacatctcctgcactggaaccagcagtgatgttgaaattctaacttgtctctgtacacatcaccaaataacgccccaaactcatcatttatgatgaccactaaagcgccctcgtaggggtttctaaatcgcttctcctggctccaagtctggcacaccggcctccctagaccaatctctgggctccgaggctagagacgaggctgattacgtactgctgcttcaattntgccgtaaggttctattcttactttatgttcctttacggacttacggggacctaaacgggtccacccgtaccgttagccaacggaccccaaggccccaaaacccgcgttcgtacctaacccg

SEQ ID NO: 417669 - DNA, 718 bp, Homo sapiens
  misc_feature: GZ8MTXP02JIRM8.19.78.H01.1.454.CMB.2.raw
  modified_base (196)..(196): a, c, t, g, unknown or other
  modified_base (262)..(262): a, c, t, g, unknown or other
  modified_base (277)..(277): a, c, t, g, unknown or other
tcagtactctcgtgcacgaccggtgctcgatttagtgtgagtagtttggggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatcctcctgcactggaaccagcagtgatgttaggaaattctacttgtctctgacanatcaccaaagtaacnccccaaatcatacatttatgatgaccataacggccggtccctacgtagggtttactaatcgtcttctcctcggtctcctaagtctggactaccgccggcctcctagaacctaatcgtcgtcgggtctacccgaggcgtacggaagggacgacggatacggtaacttaacgtaccgtagtcccgttggacccttagtaagtttaaccgtacggtacgttaacggttaccgttacttacgttaccgtttaccgtttacgttaccggttaaccgggttaaccgggtaaaccgggtaaacccggttaaaccggttaacccggttaacccgggttaacccggttaacccggttaaacccggtaaacccggtaaaccccggtaaaaccccggtaaacccccgtaaacccccgttaaccccgttaacccggttaacccgttaaccccg

SEQ ID NO: 417670 - DNA, 552 bp, Homo sapiens
  misc_feature: GZ8MTXP02F6Q35.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaactgtctctgtaccacatcaaccaaataaacgaccccaaactcatctaattatgatgaccactaacgcgccctcgtaggggtttactaatcgtcttctccgtgcctcaagtctggacacaccggcctcctagacaactctctcgggctccgagctgaggacgagctgtattactactgctgctacatatgacgtaggtctattctcttattcgtcttacggaacgtaggaccgtaaacgggttctacccgttacgtacggtccaaccggtacccaaacggtacccaacccctacgtctacttaccc

SEQ ID NO: 417671 - DNA, 776 bp, Homo sapiens
  misc_feature: GZ8MTXP02I8NQF.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttaggaaattctaaccttgtctcctggtaccaacatcaacccaaaataaacgacccccaaaactcaatctaatttatagatacgaccaacgtaacgccggacccttcgaaggggtttcctaaagtccgtcttactcctggaccttaccaaagttctacgggacaaccgccgggtccctacccgtagaacctaaattcctccgttacggggcccttccggaacggccttaggggacggtaaccgagggtaccttaggaactttaaccgtaacgttcgccgtttaggaccttacaagttaacgttcggacgtacggggttaccgttacgttacctttaccgtttaaagtcggtttaccgttttaaccggggaaaaccgtaggggggtaaaacccccctaaaagggggtttcccctaaacccccgggggttttaccgttaaaccgggggtaacccctaacccggtaaaccccccgtaaaccggggtaacccccccgaaaaacccccctcggtttaaaccccggttcccctttaaacccccggg

SEQ ID NO: 417672 - DNA, 579 bp, Homo sapiens
  misc_feature: GZ8MTXP02JNA4Z.19.78.H01.1.454.CMB.2.raw
  modified_base (444)..(444): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtccctgggcccagtctgccctgactcagtctgcctccgtgtctgggtctcctggacagtcgtcaccatctcctgcactggaaccagcagtgatgttagaaattctaaccttgtctcctggtaccaacatcaacccaaataaacgcccccaaactcatcatttatgatgccactaagcggccctacgagggtttctaatcgcttctcctgctcaagtctggcacaccggcctccctagacaatctcgtcgggcctccgaggcctggaaggacgagggctagaactttaccactgcctgcctanatagtgacgtaggttacgttacttcttacttagtcgttaccgttacggaacgtcgggaaccgtacggtccaccgtaccgtacggaccaaccggtaccccgaaaccgaccccaaaccccgtacgtacgtaccctac

SEQ ID NO: 417673 - DNA, 580 bp, Homo sapiens
  misc_feature: GZ8MTXP02ICO3U.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaactgtctctgtacacatcaccaaataacgacccccaaactcatctaatttatgatgaccactaaacgccggcccctcgaggggtttcctaaatcgtacttctcctcgctccaagtctcggacacaccggcctccctagacaatctctcgggctccaggctggacggacgaggctagtactactactgctagctcatactgctacggtcgttacttcttcgttagtcgttacttacgggtaacgtcgggaccgtaaacggttcctacccgttaccgtacggttaccgaacggaccccgaaacgggacccccaaacccgtacctcggtacctacccg

SEQ ID NO: 417674 - DNA, 549 bp, Homo sapiens
  misc_feature: GZ8MTXP02ICIMM.19.78.H01.1.454.CMB.2.raw
  modified_base (261)..(261): a, c, t, g, unknown or other
  modified_base (303)..(303): a, c, t, g, unknown or other
  modified_base (421)..(421): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacanatcaccaaataaacgacccccaaactcatactatttatgatnaccactaagccgccctgtaggggtttctaatcgcttctcctgctcaagtctgcacgacgcctcctagacatctctggctccgagctagagacgagctagtattacactgctgctcatntgcgtaggttcgtatcgttattagtcgttcgttacggaacgttcgggaaacctaaacggtccctaccggttactacggtaccgaacgaccccgaaaccggaccccaaacccgtcctacgtacctaccg

SEQ ID NO: 417675 - DNA, 542 bp, Homo sapiens
  misc_feature: GZ8MTXP02JKJX1.19.78.H01.1.454.CMB.2.raw
  modified_base (270)..(270): a, c, t, g, unknown or other
  modified_base (408)..(408): a, c, t, g, unknown or other
  modified_base (419)..(419): a, c, t, g, unknown or other
  modified_base (422)..(422): a, c, t, g, unknown or other
  modified_base (432)..(432): a, c, t, g, unknown or other
  modified_base (434)..(435): a, c, t, g, unknown or other
  modified_base (438)..(438): a, c, t, g, unknown or other
  modified_base (443)..(443): a, c, t, g, unknown or other
  modified_base (456)..(456): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatnacccccaaaataaaagacccccaaaactcaatcatttatgatgaccactaaagcggccctcaggggtttctaaatcgcttctcctgctccaaagtctggcacacggcctccctgacaaatctctgggctcccaaggcngaggacgaggntanatactactgntnntanatatncgagtcgtatctnttatgtcgtacgtaacgtacggaccgaacgtacgtaccgtaccgtacgtacgaacgaccgaacgacccaacccacctacgtactac

SEQ ID NO: 417676 - DNA, 530 bp, Homo sapiens
  misc_feature: GZ8MTXP02FMIQ1.19.78.H01.1.454.CMB.2.raw
  modified_base (359)..(359): a, c, t, g, unknown or other
  modified_base (369)..(369): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatcacccaaataaagccccaaactcatcattatgatgccactaagcgccctcaggggtttctaatcgcttctcctgctcaagtctggcacncggcctcccngacaatctctgggctcccaggctggacggacgaggctgattactactgctgctcattatgcgaggttcgtattctctttatcgttctttcggaacgttgggaactaacggtacaccgtccgtaggtcaacgacccaacggacccaacccgactcgctaccg

SEQ ID NO: 417677 - DNA, 569 bp, Homo sapiens
  misc_feature: GZ8MTXP02HVXWV.19.78.H01.1.454.CMB.2.raw
  modified_base (445)..(445): a, c, t, g, unknown or other
  modified_base (451)..(451): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactgaaccagcagtgatgttagaaattctaacttgtctcctggtaccaacatacaacccaaaataaacgcccccaaactcatcatttatgatgaccactaagcgaccctcgtagggttctaaatcgtcttctccgtgcctccaagtctggacaccacggccctcccgtgaacctaatctcgtgggcctaccgaggctaggacgacgaggctaggaacttactacgtgccttntactanatacgtacgtacgtaggtcttacttcttattacgtacgttacgtacggaacgtcggaaactacgtacctaccgtcgtacgaccaaccgacccgaaccgacccaaccctactactactc

SEQ ID NO: 417678 - DNA, 528 bp, Homo sapiens
  misc_feature: GZ8MTXP02F1JUJ.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtgaaattctaacctgtctctgtaccacatcacccaaataaacgcccccaaatcatcatttatgatgaccactaagccgccctcgaggggtttctaaatcgtcttctcctggcctacgaagtctcggcaccacggccctccctgaacaatctctgggctcccgagctgaggacgaggctagattactactgctgctacattatgcgaggttctattctctttatcgttcttacggaactgggaccaaggtcaccgtctaggtccaagccccaaggcccaacccgactcgtctacc

SEQ ID NO: 417679 - DNA, 596 bp, Homo sapiens
  misc_feature: GZ8MTXP02HDN8E.19.78.H01.1.454.CMB.2.raw
  modified_base (358)..(358): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttggaaattctaacttgtctcctgtaccaacataccaacccaaataaaccgaccccaaaactctaatcctaatttaatgatacgaccaactaagccgccctcgtagggtttctaaatcgcttcnccctggcctacaagtctcggacaccgaccgccctccctagaactaatccttacgtcgggcctcccgaggcctagggaaggacgaggcctagtacttacctattgctgtctacatagtgacctagggtcctactcttaccttagtcgtacgttaccggaacgttgggaacctaaacggtcctaccgtcgttaacggcaacgaccccaaacggtcccaaaccccctggtcttacaccccg

SEQ ID NO: 417680 - DNA, 724 bp, Homo sapiens
  misc_feature: GZ8MTXP02HGYS4.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcaccatctcctgcactggaaccagcagtgatgttaggtaaacttctaaccttgtcctctaggtaaccaacactaccaaacccaaaactaaaccgacccccaaactcaactactatttatgatcgaccacgtaacgccggtacccttaggtacggggtttactaacgttccgtacctttcgtacccgtcggtacctaccgtaagttccgtcggaccaccgaccggtccctacccgtagaacctaactccgttcgtcggggtctaccggaggtcgtaggaacggacggacgtcgttacgtaacgtttaccgtacgttcgtcgttacgtacttaacgtaattacgggtacgtcgtaacgggtttactttacttacgtttacgtttagttaccggttacgttaaccggggtaaccggttacggggtaaacccgtaacggtaccgttaaccccggtccggttaacgaccgtaacccgaacccgaaacccggtacccctaaaccctcgtaccgttacccgttacccg

SEQ ID NO: 417681 - DNA, 548 bp, Homo sapiens
  misc_feature: GZ8MTXP02IVCLD.19.78.H01.1.454.CMB.2.raw
  modified_base (403)..(403): a, c, t, g, unknown or other
  modified_base (425)..(425): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctggtaccaacatcaccaaataaacgcccccaaatcatcatttatgatgccactaagccgccctacgtagggtttctaatcgcttctcctgctcaagtctggcacgccgcctccctagaccaatctcgtggcctcgagctgaggacgnggctgattactactgactgctnattatgactaggtctatcttctatgtaccgttacggacgttggggaaccctaagggtccctaccggtacctagggtaccaacgaccccgaacggaccccaaccccgtacttacgtacctaccg

SEQ ID NO: 417682 - DNA, 586 bp, Homo sapiens
  misc_feature: GZ8MTXP02G6C7E.19.78.H01.1.454.CMB.2.raw
  modified_base (379)..(379): a, c, t, g, unknown or other
  modified_base (439)..(439): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgattgttaggaaattctaaccttgtctcctggtaccaacatcacccaaataaacgaccccaaactcatacattatgatgccactaagcgccctcgtagggtttctaatcgcttctcctggcctcaagtctaggcacaccggccctccngacaactctcgtcgggctcccgagctaggacggacgaggctagacttactactgctgctnattagtgcgtaggtcgtattcgttacttagtcgttaccgttacggaacgttcgggaacccgtaaggtcccgtaacccgttaccgtacggttaccgaaccgtacccgaaaccggaccccaaaccccgtacgttaccgtccttaacccg

SEQ ID NO: 417683 - DNA, 553 bp, Homo sapiens
  misc_feature: GZ8MTXP02I1K6X.19.78.H01.1.454.CMB.2.raw
  modified_base (353)..(353): a, c, t, g, unknown or other
  modified_base (377)..(377): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttgaattctaacttgtctctgtaccaacatcaaccaaataacaccccaaatcatcatttatgatgaccactaagccggcccttgtaggggtttctaatcgcttctctcggctcagtcnggcacgcgccctcctgacatctcncggctcaggctgaggacgagctagattactacgtgctagctactagtagtcgacgtacgggtactacttcttcttagttcgttcgttacggaacgttagggaacctaaaggttcctaccgtaccgtaggtccaacggacccgtaaacggccccaaacccgcttacgtacctacccg

SEQ ID NO: 417684 - DNA, 603 bp, Homo sapiens
  misc_feature: GZ8MTXP02FJSMI.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctggtaccacatcaccaaataacgccccaaactcatcatttatgatgccaactaagccggccctcgaggggtttctaatcgtcttctcctggctccaagtctcggcacgacggccctccctgactaatctctgggctcgaggctggaggtacgacggctgtattacgtactgcgtgtctactatatgcgtaggtcgttaacttctacttagttcgttccgttaccgggtaacgtaccggggtaaacctaaacgggttcccgaacccgttacccgttaggttacccgaacggtacccccgaaacggggtaccccctaaaccccgtaacgttcgtaccttaaccccg

SEQ ID NO: 417685 - DNA, 614 bp, Homo sapiens
  misc_feature: GZ8MTXP02GZKV5.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatacaaccaaataaacaccccaaactcaatctatttatgatcgaccactaacgccggccctacgtaggggtttactaatcgtcttcacctggcctaccgtaacgtctacggaccaccgaccggcctcccgagaactaactctcgtcgggcctccgagtcgtaggacgggtacgacggtctagtaacttacgtactgtctcgctactatagtcgcgtaacggttcttactcttacgttagtcgttacgttaccggtaacgtacgggtaacctaacgggttacctaccgttacgtaacggtaccgaaccgaccccgaaaccgaccccaaccccgtacgttcctacgtaccc

SEQ ID NO: 417686 - DNA, 546 bp, Homo sapiens
  misc_feature: GZ8MTXP02FL3CI.19.78.H01.1.454.CMB.2.raw
  modified_base (413)..(413): a, c, t, g, unknown or other
tcagtactctcgtgcacgaccggtgctcgatttagtgtgagtagtttgggtttgggggggtcacaagaggcagcgctctcgggacttctccaccatggcctgggctctgctgctcctcactctcctcactcaggacacagggtcctgggcccagtctgccctgactcagtctgcctccgtgtctgggtctcctggacagtcggtcaccatctcctgccactggaaccagcagtgatgtggaaattctaacttgtctctgtaccaacatcaccaaataaacgacccccaaactcatcaatttatgatgccactaagccggccctctaggggtttctaaatcgacttctcctggctccaagtctggcacaccggcctcctgacaatctcgtcgggctccgaggctggaggtacgngctgattacactgctgctcatatgctaggtctattcttacttatcgttcgttacggaacgtcgggaaccctaaggtccaaccgtaccgtaggtaccaacgacccaaacggacccaaccccaactcgactaccc

SEQ ID NO: 417687 - DNA, 626 bp, Homo sapiens
  misc_feature: GZ8MTXP02GFMS4.19.78.H01.1.454.CMB.2.raw
  modified_base (312)..(312): a, c, t, g, unknown or other
  modified_base (380)..(380): a, c, t, g, unknown or other
  modified_base (391)..(391): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttaggaaattctaacttgtctcctggtaccaacatacaacccaaaataaacgaccccaaactcaactctaatttatnactgaccactaacgccgccctcgtacgggtttactaactcgtcttctcctcgcctcaagtctgacacnccgcctcctanacactctctcgggctccgagtctggacggacgacggactgtaacttactacgtgtactcgtacttacgaattagtacgtaccgtaacgggtttcttacttcctttcttttaacgtacgtttccgttaacgggtaaccggttacggggaaacccgtaaggtaccctacccggttacgtacggtaccaaccgaccccgaaaccggacccctaacccctaacgtccgtaccttacccg

SEQ ID NO: 417688 - DNA, 694 bp, Homo sapiens
  misc_feature: GZ8MTXP02I529G.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactcggaaccagcagtgatggttagtaaattctaaccttgtctcctagtaccaacactacaaccaaataaacgaccccaaatcatactattatagatacgacctactaacggccgtccctacgtacgggtttacctaaattccgtctttcctccgtcggtcctaccgtaacggtccgttacggaccacccggtacccggtacccccttacccgtacgaaaccttaaacgttccgttaccgttcgggggtacccttacccggaacgggtaccgttagggaacggaaacggcggtacgttacggtaacttaccgtacgttcgtccttaggtcctatagttatcggtaccttagggttcttactttacgttctttaacgtcgtttacgttaacggtacggtacgggtaaccgttacggaccttaccgtaccgtacgtaccgaacggaccccaacggtacccaaccgtcgtacctcttaaccc

SEQ ID NO: 417689 - DNA, 626 bp, Homo sapiens
  misc_feature: GZ8MTXP02GH6TX.19.78.H01.1.454.CMB.2.raw
  modified_base (221)..(221): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcgtcacatctcctgcactggaaccngcagtgatgttagaaattctaactgtctctgtaccacatcaaccaaataacgaccccaaatcatctatttatgatgccaacgtaacgccggccctacgtacggggtttactaaagtcgtacttctaccgtcggcctacaagtctacggacaccgaccgggccctaccctagaacctaactcctcgtcggggccttacccgagggtcctagggaacgggaacgagggtctaggtaacttaccgtaacgtggtcctgtcctacattagtgactagggtactattcttctttagtcgttacgttacggaacgttacgggaaccgtaaacggtacctaccggttaccgtacggttaccaaccgtaccccgaaacggacccctaacccctacgttacgtaccttaacccg

SEQ ID NO: 417690 - DNA, 722 bp, Homo sapiens
  misc_feature: GZ8MTXP02FX6RT.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtaccacatcaccaaataaacgccccaaactcatctaatttatagatcgaccaactaacggccggacccgttacgtaggggttttacctaaagttccgtctttctccgttcggtcctaccgtaaacgttcgtacgggacctaccgaccgggccccttacccctacgaacctaaacgttcgttaccgttcggggtcccttacccggaacggggtccgttagggaacgggtaaccgggaacggggtaccgttaggtaactttaaaccgttaccgttacggtaccgttgtaccttactacgttagtaccgtacgtacggttacgttaactttctttaccgtttagttacggttacctttaacggggtaaccgttaacggggaaaccgttaaacgggttaccctacccggttaccgtacggtaccaacggaccccgaaacggaccccaacccgtactacgccttacccg

SEQ ID NO: 417691 - DNA, 790 bp, Homo sapiens
  misc_feature: GZ8MTXP02HTVWN.19.78.H01.1.454.CMB.2.raw
  modified_base (221)..(221): a, c, t, g, unknown or other
  modified_base (292)..(292): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacaggtcctgggccagtctgccctgactcagtctgcctccgtgtctggtctcctggacagtcgtcacatctctgcactggaaccngcagtgatgtagaattctacttgtctctgtacacatacaaccaaataacgaccccaaactcatctatttangatcgaccaacgtaacgccggccttcggtagggtttactaagttccgtctttacctccgtcggcctacgaagttcgtacggacaccgtaccggtccctacccgtacgtaacctaacgttccgtaccgtcggggtacctacccggaagggtcgtaacgggaacgggacggtaacggtacttaggtaaacctttaacgtaccgttacgtccggttcgttacccgtttaccaaagtttaacggtccggttaaccgttaaccggggtttaccgtttaacgtttccccttttaagttttaaaccgtttcgggtttaaacccggtttaacccggggttaaaacgggtttacccgggggtaaaaaccccgttaaaccggggtttaccccgtaaccccggtttaacccggttaaccgggtaccccgaaaacccgggtaacccccgtaaaacccgggttacccccaaaaccccgttaccgtttacccggtttaccctttaaaccccg

SEQ ID NO: 417692 - DNA, 582 bp, Homo sapiens
  misc_feature: GZ8MTXP02FNNC2.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaaattctaaccttgtctctgtaccacatcaccaaataacgccccaaactcatcatttatgatcgccaactaaggccggccctcgaggggtttctaatcgcttctcctggctacaagtctggacaccgcgccctcctagacaatctctcgggctccgaggcgtggaagggaccgaggtcctagtaacttactactggctgtctacatagtcgacgtacgggttctaattcttacgttagtcgttaccgttaacggaacgttggggaaacccgtaaaggttccgtacccgttacgtacggtaccaacgaccccgaacggaccccaaccctacgtacgtcctaacccg

SEQ ID NO: 417693 - DNA, 563 bp, Homo sapiens
  misc_feature: GZ8MTXP02HYC7I.19.78.H01.1.454.CMB.2.raw
  modified_base (316)..(316): a, c, t, g, unknown or other
  modified_base (360)..(360): a, c, t, g, unknown or other
  modified_base (432)..(432): a, c, t, g, unknown or other
  modified_base (438)..(438): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgacaacatcaccaaataacgccccaaactcatcatttatgatgccataagcggccctnagggtttcatcgcttctcctgctcaagtctggcacacgcctccngaacactctcgtcggctccgagcgtggagacgaggctagacttacacgtgctagctcatagtgcgagtcgtntacttnttagtcgttacttacggaacgttacgggaaccgtaacggttccctacccgttaccgtaacggttccaaccggtacccccgaaaacggacccccaaaacccccgtacttccggttaccttaacccg

SEQ ID NO: 417694 - DNA, 521 bp, Homo sapiens
  misc_feature: GZ8MTXP02GWX5G.19.78.H01.1.454.CMB.2.raw
  modified_base (443)..(443): a, c, t, g, unknown or other
  modified_base (449)..(449): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctcctggtaccaacatcacccaaataaacgcccccaaatcatcatttatgatgccactaagcggccctcgtaggggtttctaaatcgctttctccctgtctcaagtctggacacaccggcctccctgaacaatctctgggcctcaggctgaggacgaggctagacttactactgccttgctcattagtncaggtntaatctattatgtcttacggactgggaccaaggtccacgtcaggtcaacgcccaagcccaacccatctacac

SEQ ID NO: 417695 - DNA, 582 bp, Homo sapiens
  misc_feature: GZ8MTXP02HW7TE.19.78.H01.1.454.CMB.2.raw
  modified_base (279)..(279): a, c, t, g, unknown or other
  modified_base (364)..(364): a, c, t, g, unknown or other
  modified_base (372)..(372): a, c, t, g, unknown or other
  modified_base (434)..(434): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcactggaaccagcagtgatgttaggaaattctaacttgtctctgtacaacatcaaccaaataaacncccccaaactcatctatttatgatgaccactaacgcgccctcgtagggtttctaagtcgtcttctctgctacagtctaggacacncgcctccngacatctcgtggctcgagcgtagacggacgaggtctagacttacactgctgcttacattagngtacgtaggtcttacttcttacttacgttcgttaccgttacggtaacggttacgggggaaacctaacggggttaccctacccggttaccgtacggtaccgaaccgaccccgaaacggacccccaaccgtaccgtcgttaccgtacccg

SEQ ID NO: 417696 - DNA, 614 bp, Homo sapiens
  misc_feature: GZ8MTXP02F932T.19.78.H01.1.454.CMB.2.raw
  modified_base (482)..(482): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtaccacatcaaccaaataacgaccccaaatcatctatttatgatcgaccaactaacgccggccctcgtaggggtttactaactcgtacttctcccgtacggcctaccgaagtcgtacggaccaccgaccgtccctcccgtagaacctaactcgtacgtcggggtcctacccgaggtacctaggaggtacgacggtctaggtacttacgtacgtcgctcgcttanacttagtcgacgtaggtcttactcttacttagtcgttcgttacggtaacgtacggaaccgtaaacggtcctaccggtaccgtacgtaccaacggacccgaaacggaccccaaacccgctaacgtcctacccg

SEQ ID NO: 417697 - DNA, 522 bp, Homo sapiens
  misc_feature: GZ8MTXP02GE2VL.19.78.H01.1.454.CMB.2.raw
  modified_base (369)..(369): a, c, t, g, unknown or other
tcagtactctcgtgcacgaccggtgctcgattagtgtgagtagtttgggtttggggttcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacctgtctctgtaccaacatcacccaaaataaacgcccccaaactcatcatttatgatgccactaagcggccctcgtaggggttttactaaatcgtctttctccgtggctaccaagtctggcacncggcctcctgacaatctctgggctccaggctggagacgtaggctgattactctgctgctacatagtgcagggtctaatctcgttatgtcttcggaaacttgggaccaaggtcaccgtcaaggtcaagccaaacggtccaaccccatcgctacc

SEQ ID NO: 417698 - DNA, 619 bp, Homo sapiens
  misc_feature: GZ8MTXP02JBKM4.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcactggaaccagcagtgatggttaggtaaattctaaccttgtctcctgtaccaacactacaaccaaactaaaccgaccccaaactacatactattatgatcaccacgtaacgccgtacccgtacgtaacgggtttactaacgtccgtactctccgtcgcctccgtaagtctggaccacgccgtcctaccctacgaactaacttcgtcgtccgggtacctaccgaggccgtaggacggacgacggtctagtaactactagtgctgctacgtagtactgacgtagttctaactcttacttatcgttaccgtaacgggtacgtacgggtaaaccgtaacgtcgtaccgtacgttcggaacgaacgaccccgtaaccgacccctaaccgtacctcggtacctacccg

SEQ ID NO: 417699 - DNA, 554 bp, Homo sapiens
  misc_feature: GZ8MTXP02GXNIR.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaacttgtctctgtaccaacatcaccaaataacgaccccaaactcatctatttatgatgaccactaacgccggccctcgtaggggtttcaatccgtacttctcctggctcaagtctggcacgaccgcctccctagacatctcgtcgggcctccgaggctaggaggacgaggctagattacgtactgctagctcattgtgacgtaggtctactcttacttagtcgttacgttacggacgtggaacccgtaggtaccgtaccgtaccgtagtaccaacgacccgaacggaccccaacctactcgtacctaccg

SEQ ID NO: 417700 - DNA, 509 bp, Homo sapiens
  misc_feature: GZ8MTXP02JWLMS.19.78.H01.1.454.CMB.2.raw
  modified_base (322)..(322): a, c, t, g, unknown or other
  modified_base (357)..(357): a, c, t, g, unknown or other
  modified_base (411)..(411): a, c, t, g, unknown or other
  modified_base (415)..(415): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtgatgttggaaattctaaccttgtctcctggtaccaacatcacccaaataaacgccccaaactcatcatttatgatgcataagcgccctnagggtttcaatcgcttctctgctcagtctggcacncgctccctgacatctctggctccagctgagacgagctgattacgactgctgctnatangacaggtctactctcttgtgtcgtacgtacgtacggacgacgtacgtaccgtacgtacgtacgaacgaccgaacgaccacccaccgtacgtctc

SEQ ID NO: 417701 - DNA, 655 bp, Homo sapiens
  misc_feature: GZ8MTXP02G4GZD.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacagtcggtcaccatctcctgcactggaaccagcagtgatggttagaaattctaacttgtctctgtaccaacatcaaccaaataacgaccccaaactcatactattatgatcgaccactaacgccgtccctacgtaggggtttctaaacgtcgtcttctccgtcggtcctaccaagtctacggacaccgacggccctcccgtagaacctaactcctcgtcgggtcctccgaaggtccgtaggaagggtacggacggctagtacttacgtactcggcttcgaccttatagtagttcgacgttacgggtacgttacttctttacgtttacgttcgttacgttacgggtaacgtacggggtaaccctaaacgggtcccgtaaccgttaccgttacggtacccgaaccggaccccgtaaaccgggaaccccctaaacccgtaccgttaccggtaccgttaccccg

SEQ ID NO: 417702 - DNA, 669 bp, Homo sapiens
  misc_feature: GZ8MTXP02IJYXJ.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtacacatcaccaaataacaccccaaactcatcatttatagatcgaccactaacgccggtaccctgtacgggttctaaagtcgtcttctccgtcgacctactaacgtctacggaccaccgtaccggtccctacccgtacgaacctaactcgttccgtcggggaccttacccgaagggtccgttagggaacgggacggacgggtcttagtactttaacctacgtcgtaccttcgccttactaagttacgtcggtacgtacggttacgttaacttcttactttacgtcgttaccgttacgggaaaccgtcggggaaacctaaacgggtccgtaacccggtaccgttacggtacccgaacgaccccgaaaaccgggccccctaaaaccccgtacgttccggtaccttaacccg

SEQ ID NO: 417703 - DNA, 712 bp, Homo sapiens
  misc_feature: GZ8MTXP02JYLP0.19.78.H01.1.454.CMB.2.raw
tcagtactctcgtgcacgaccggtgctcgatttagtgtgagtagtttgggtttgggggctttatttgggctctgctgctcctcactctcctcactcaggacacagggtcctgggcccagtctaccctgactcagtctgcctccgtgtctgggtctcctggacagtcggtcaccatctcctgcactggaaccagcagtgatgtaggaaattctaaccttgtctcctggtaccaacatacaaccaaataaacgaccccaaactcatctattatgatcgccactaacgccgtccctcgtagggtttactaatcgtcttctctggctccaagtcgtaggaccaaccgtaccggtccctaccctacgaacctaaacgttccgttcccgtcggggtcctaccgaacgggtcgtagggaacgggaccggacgggtacttacggtaactttaacctaacgtcggtccgttcgccttaacctaagttaacgtcggtacccgtagggttaccgttatttccgtttacgtttacgttacgttaccggttaaccggggtaaccggtaccgggtaaccggtacgtacccgtaccgtaccgtacggtaccgacccgtaccgaaccgacccctaaccctacggtacctcctacctcccgtcccttacccctacccctacctacccacgtaacgtacgtccgtacggccggtcggcgtacggaaccgg

SEQ ID NO: 417704 - DNA, 623 bp, Homo sapiens
  misc_feature: GZ8MTXP02FJLS5.19.78.H01.1.454.CMB.2.raw
  modified_base (270)..(270): a, c, t, g, unknown or other
  modified_base (340)..(340): a, c, t, g, unknown or other
  modified_base (349)..(349): a, c, t, g, unknown or other
  modified_base (408)..(408): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgccccaaactcatcatttangatgaccactaacgccggccctcgtaggggtttactaatcgtcttctctcggctccaagtctggacaacncggcctccngacatcctcgtcggctccgaggctggaggacgaggctagattactactgctgactcatntgacgtggtcgtattcttacttatcgttacgtacggtaacgtcgggaacctaacgggtacctacccgtacgtacggtaccgaccgacccgaaaaccggtccccaaaaccccgtacgttacgtaccctaaccttcccgttacccgttacccccctaaccccttccctacccgaacggtaacgtaacgttacggtacgacggccgggtcgaacgggg

SEQ ID NO: 417705 - DNA, 554 bp, Homo sapiens
  misc_feature: GZ8MTXP02JOCK8.19.78.H01.1.454.CMB.2.raw
  modified_base (227)..(227): a, c, t, g, unknown or other
  modified_base (233)..(233): a, c, t, g, unknown or other
  modified_base (295)..(295): a, c, t, g, unknown or other
  modified_base (435)..(435): a, c, t, g, unknown or other
  modified_base (462)..(462): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtnatgtgaaattctaactgtctctgtacacatcaccaaataacaccccaaactcatctatttangatgacactaagccggtccctcgtagggtttctaatcgtcttctcctgcctcaagtcgtacggcacgaccggtcctccctagacaactctcgtgggcctaccgagctggaggacgaggctagacttactactgctgactnactagtcgcgtaggtcttatctacttntacgtcgtttacgacgtacggaaccaaggttcctaccgtacgttacggccaacgacccgtaaaccgaccctaacccacgtccgtactacccg

SEQ ID NO: 417706 - DNA, 707 bp, Homo sapiens
  misc_feature: GZ8MTXP02I4WFN.19.78.H01.1.454.CMB.2.raw
  modified_base (262)..(262): a, c, t, g, unknown or other
  modified_base (703)..(703): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgtaggaaattctaacttgtctctgtaccaacatacaccaaataacgccccaatcatcaattngatcgaccaactaacgccggtccctacgtaggggtttactaacgtcgtcttctcgtggtcctaccgaagtctaggaccaactcggccctacctagaacctaatcccctacgtcgggactaccgaggtaccgtagacggggacgtaacggctacggtaatttacccgtagtcggtaccttcgccttaccgtaagttaacgtcggtaacggtacggggtttacgtaaacgtttcccttagttttaacgttcggtttaccgtttaccgggtaaaaccggttcgggtaaacccggtaaacgggttaccggtaaacccgttcggtaacggttcccgaacgaccccgaaacgggacccaaaccccgttacgtacgttacctacccgttcttcccgtcccccgaccttcccgacgtaacgaacgtacgtaccgacggccgcggtaacncggg

SEQ ID NO: 417707 - DNA, 654 bp, Homo sapiens
  misc_feature: GZ8MTXP02F62Z1.19.78.H01.1.454.CMB.2.raw
  modified_base (230)..(230): a, c, t, g, unknown or other
  modified_base (390)..(390): a, c, t, g, unknown or other
tcagtactctcgtgcacgaccggtgctcgatttagtgtgagtagtttggggtttgggggtcacaagaggcagcgctctcgggacgtctccaccatggcctgggctctgctgctcctcactcctcctcactcaggacacagggtcctgggcccagtctgccctgactcagtctgcctcgtgtctggtctcctggacagtcggtcacatctcctgcactggaaccagcagtnatgtgaattctactgtctctgtacacatcaccaataacaccccaaactcatactatttatgatcgaccaactaacgccggccctgtacggggtttactaaactcgtacttctccgtcggtcctacagtctcggactaccaccggtccctctcccccgaanaacttctcgtcgggtcctaccgagctgacgggacgagcctagtacttacctactgactgtctacgtatagtcgacgtacggggttacttcttacgtttcgttaactttcgggttaccgtttaccgggtaaacgttaccgggggtaaaccgttaaaccggggttccctaacccggtttacccggtaacggttaccgaaaccggtacccccgtaaacgggaacccccaaaacccccgtacggtttacctacccgtttaaaccccgg

SEQ ID NO: 417708 - DNA, 571 bp, Homo sapiens
  misc_feature: GZ8MTXP02GTT8D.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctggtaccaacatacaacccaaataacgacccccaaactcatacattatgatgaccactaacgccgccctcgtagggtttactaatcgtcttctcctggcctccaagtcgtcggacaccgacggccctaccctagaccaatcctcgtcgggcctccgagcctggagacgagctagaattactactgctgctcatatgacgtaggtactacttcttcttagtcgttctacggtaacgtacgggaaacctaaggtacctaccgtacgtacggtaccaacgacccaacggaccccaaacccctagtcgtacctaccg

SEQ ID NO: 417709 - DNA, 571 bp, Homo sapiens
  misc_feature: GZ8MTXP02IAVQ3.19.78.H01.1.454.CMB.2.raw
  modified_base (301)..(301): a, c, t, g, unknown or other
  modified_base (375)..(375): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacagtcggtcaccatctcctgcactggaaccagcagtgatgttagaattctaacttgtctctgtaccaacactccaaccaaataaccaccccaaactcatcatttangatcgacactaacgccgcctacgtagggttactatcgtcttctccgtgctcatcgtcgacacaccgtcctaccngacactctcgtacgctcgaggcgtaggagggacgaggtctagtaactttacgtactcggtctacgtccttagtattacgtgaccgttagttcgttaacttcgtttaactagttcgttacgtacggtaaacgttcggaaaccgtaacggcctaccgtcgtacggcaacgacctaacgcccaacccgactcgtactcc

SEQ ID NO: 417710 - DNA, 739 bp, Homo sapiens
  misc_feature: GZ8MTXP02IVC6P.19.78.H01.1.454.CMB.2.raw
  modified_base (259)..(259): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcacatctctgcactggaaccagcagtgatgttagaattctaacttgtctctgtacaanatacaccaaataaacgacccccaaatcatctaattatagatgaccaactaaacggccggaccccgttacgtaaggggttttactaaacgtccgtcctttaccttaccgtcgggtacctaccgtaaaacgttccgtacgggaccaaccgtaccgggtccctacccgtagaacctaaattccgtacgtcggggcctaccgtaggcctaggaacgggtacgacgggtactacggtaactttaacgtaacttcggtacttcgacttactaattagtacgaccgtagggttacttaacttaccgtttatttaacgtcggtttaccgtttaaaaccgggggtaacttacgggggtaaaccccgtaaaacgggttccctaaacccgggtttacccgttaacggggttaacccgtaaaccgggaacccccgtaaaaccgggtaccccccaaaaaccccggtaacctttcggtaacccgtttaaccccg

SEQ ID NO: 417711 - DNA, 531 bp, Homo sapiens
  misc_feature: GZ8MTXP02GOCTG.19.78.H01.1.454.CMB.2.raw
  modified_base (303)..(303): a, c, t, g, unknown or other
  modified_base (356)..(356): a, c, t, g, unknown or other
  modified_base (366)..(366): a, c, t, g, unknown or other
  modified_base (376)..(376): a, c, t, g, unknown or other
  modified_base (424)..(424): a, c, t, g, unknown or other
  modified_base (439)..(439): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtaccaacatcaccaaataacacccccaaactcatcatttatgatnaccataagccgccctgagggtttctaatcgcttctcctgctcaagtctgcacncgcctcctanacaatctcgnggctccgagctggaggacgaggctagattacactgcttgcttcattangactaggtctatctnttagtgtccttacggactcgggaacctaaaggtcctaccgtcgtaggtccaacgtaccccgaaaggccccaacccgacgtccgtctaacccg

SEQ ID NO: 417712 - DNA, 516 bp, Homo sapiens
  misc_feature: GZ8MTXP02GC7J6.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtaccaacatcaccaaataacgacccccaaactcatcatttatgatgccactaagcgccctgtaggggtttctaatcgcttctcctggctcaagtctggcacacggccctcctgacaatctctgggcctccagctggaggtacgaggctagattacacttgctgctcatatgctaggtctatctcttatcgtcttacggacgtggacctaaaggtcaccgtcgagtcaacgcccaacggcccaaacccgctcgctacccg

SEQ ID NO: 417713 - DNA, 586 bp, Homo sapiens
  misc_feature: GZ8MTXP02HGKUD.19.78.H01.1.454.CMB.2.raw
  modified_base (305)..(305): a, c, t, g, unknown or other
  modified_base (451)..(451): a, c, t, g, unknown or other
  modified_base (456)..(456): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctgtaccaacatacaaccaaataacaccccaaactcatctattatnatcgaccactaacgccgtccctcgtagggtttctaatcgtcttctcctggcctacagtctcggacaccgaccgcctccctagaacctatctcgtacgggcctcgaggcgtaggaacggacgagctagtaacttactactgctgctnatagngcgtacggtcttactcttcttagttcgtacgttacggaacgttacgggaacctaacggtacctaccggttacctaacggtacaaaccggacccgaaaccggtcccaaaaccctcgtaccgtacctacccg

SEQ ID NO: 417714 - DNA, 515 bp, Homo sapiens
  misc_feature: GZ8MTXP02GRSUZ.19.78.H01.1.454.CMB.2.raw
  modified_base (369)..(369): a, c, t, g, unknown or other
  modified_base (441)..(441): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctctgtacacatcaccaaataacaccccaaactcatactattatgatgaccactaagccgccctcgagggtttactaatcgtcttctcctagctacagtctgacacacgcctccngacatctctggctccgagctgaggacgaggctgacttacacgtgctagctacatatgcgtagtcgtatcctnttatgtcttacgacgtaggaccaagtccacgtcctaggtacaacgacccgaagaccccaaccacgtcgtctacc

SEQ ID NO: 417715 - DNA, 781 bp, Homo sapiens
  misc_feature: GZ8MTXP02HI2KK.19.78.H01.1.454.CMB.2.raw
  modified_base (280)..(280): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcacgtggaaccagcagtgatgttagaaattctaacttgtctctgtaccaacatcaccaaataacnccccaaactcatcatttatgatcgaccaactaaacgccggtacccctacgtacggggtttactaaattccgtctttctccgtcggccttaccgaacgttctacggaccaccgacccggtaccctaccccgtagaacctaaactccgtcgtcggggtccttacccgagggaccgtagggaacgggaaccggtaacggtcgttaacggtaaactttaccgtaaccgttacgggacctttggaccctttaccgtaaatttaacgtcggtaccgtacggggtttaccgttaactttccgtttacctttaagtttccgggtttacccggtttaaccggggtaaaacccggtttaccgggggtaaaaccccgttaaaaccggggttaccccgttaaaccccggggtttaccccggttaacgggttaaccccgtaacccggtaacccccgaaaacccgggacccccctaaaacccccggtaaccttccggttacccctttaaccccgg

SEQ ID NO: 417716 - DNA, 577 bp, Homo sapiens
  misc_feature: GZ8MTXP02H9Q8J.19.78.H01.1.454.CMB.2.raw
  modified_base (300)..(300): a, c, t, g, unknown or other
  modified_base (361)..(361): a, c, t, g, unknown or other
  modified_base (371)..(371): a, c, t, g, unknown or other
  modified_base (379)..(379): a, c, t, g, unknown or other
  modified_base (412)..(412): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagcctgcctccgtgtctgagtctcttggacagtcatcacatctcctcatgggaccgtgtgatggtggacttactacccttgtctcctggtaccaacaactaccccggcaaacgcccccaaactcctgatttangagctcatagcgcctgagggtttcatcgcttctctggctccagtctgcaacacggcctccngacactctcncggctccngctgagacgagctagattacacgtgctgacctntactaagttcgacgtagggtccttattcctcgtttatcgtttactacgggtaaacgtacgggaacctaaacggttaccgaccggttccgtaagggtaccaccggtacccgaaaaccgggccccctaaaacctcggtctacaccggtttccttaccgttccccccg

SEQ ID NO: 417717 - DNA, 741 bp, Homo sapiens
  misc_feature: GZ8MTXP02H8X3H.19.78.H01.1.454.CMB.2.raw
  modified_base (226)..(226): a, c, t, g, unknown or other
  modified_base (526)..(526): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcacgtggaaccngcagtgatgttagaattctaaccttgtctctgtacaacatcaaccaaataaacgccccaaatcatctaatttactgatcgacctagtaaacgccggtaccctagtacggggtttactaaacgttccgtactttcgttaccctacgggtcctaccgaaacgttcgtaggacctaaccgtaccgggtccctaccccgttacgaacctaaacgttcttacccgtcggggtacccttaccggaaaggtccgttaagggacggttaacggaacgggtccttaggtaactttaaccgtacttcggnttacggccttagaacttagtccgagtacgggtcttaacgtctttaccttagttcgttacccgtttaggaaaccggttcgggtaaacctaaacggggtcccctaacccgggtttacccgtaacggggttaccctaaaacccggggtaccccctaaaaaccgggggaccccctaaaaacccccggtaaccctttccggtttaaacccgttacccccg

SEQ ID NO: 417718 - DNA, 746 bp, Homo sapiens
  misc_feature: GZ8MTXP02IKSRG.19.78.H01.1.454.CMB.2.raw
  modified_base (298)..(298): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatggttagaattctaacttgtctctgtacacatcaaccaaataaccaccccaaactcatactatttangactcaccacgtaacgccgtcctagtacggtttactaagtcgtacttctccgtcgcctacagtcgtacggacaccgaccgtccctacccgtgaacctatccgttcgcgggtcctaccgacggtcgtacggacgggacggtacggtacttaggtaacctttaccgtacgtcggtaccttcgaccctttagtaatttaacggtcgtacggttaaccgggtttacctttaaacgtttccttttaaccgtttaacgtttccgggtttaaacccggtttacccggggttaaaaccgggttaaccgggggtaaacccttaaaaccggggttacccctaaccccggtttaaacccgtttaacggtaacccgaacccggttaaccccggaaacccggggttcccccgttaaccccggttaccccccggttccgggtttaacccctttacccccggg

SEQ ID NO: 417719 - DNA, 579 bp, Homo sapiens
  misc_feature: GZ8MTXP02GGWCG.19.78.H01.1.454.CMB.2.raw
  modified_base (301)..(301): a, c, t, g, unknown or other
  modified_base (358)..(358): a, c, t, g, unknown or other
  modified_base (438)..(438): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaacttgtctctgtacacatcaaccaaataacaccccaaactcatctattatgatnaccactaacgcggccctgtagggtttctaatcgcttctcctcgctcagtctggcacncgcctcctgacatctctcggtctccgaggcgtacgaggacgaggtctagtacttactacgtgtacctgctacgtatagtncgtagttccgttaatcgttcttagtcgttacgttacggtaacgtcgggtaaacctaacggttcctaacccgttccgtaacggtaccaaaccggtaccccgaaaccggtacccccaaaccctacgtaccgtacctaaccccg

SEQ ID NO: 417720 - DNA, 656 bp, Homo sapiens
  misc_feature: GZ8MTXP02HCHCI.19.78.H01.1.454.CMB.2.raw
  modified_base (224)..(224): a, c, t, g, unknown or other
  modified_base (230)..(230): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccngcagtnatgtagaaattctaacttgtctctgtaccaacatcaacccaaataaacgccccaaactcaatctactttatgatgaccactaacgccggccctctaggggtttactaaatccgtcttctcctcggctcctaagtcgtcggacacgaccggtcctccctagacctaatcctcgtcgggccttacccgaggtccgtaggacgggtacgaacgggtcgttagtaacgtttactacgtacggtcttacgtccttacacgttaactgaccgtacgggttacgtttaacttctttccgtttaatcggtttacgtttaccggtaaccggttacggggtaacccgtaaagggtcccgtaccggttacccgtacggtacgaaccgccccgaaaacggtcccccgaaaccccctacgttaccgtaccttaacccgg

SEQ ID NO: 417721 - DNA, 511 bp, Homo sapiens
  misc_feature: GZ8MTXP02I5EFZ.19.78.H01.1.454.CMB.2.raw
  modified_base (197)..(197): a, c, t, g, unknown or other
  modified_base (342)..(342): a, c, t, g, unknown or other
  modified_base (378)..(378): a, c, t, g, unknown or other
  modified_base (469)..(469): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcaccatctcctgcactggaaccagcagtgatgttagaaattctaacttgtctctgtaccaacatcaaccaaataaacgaccccaaactcatcatttatgatgaccataacgcgccctgtacgggtttctaatcgcttcncctgcctcaagtctgcacacggcctcctgacatctntcggctccgagctggaggtacgagctagattactactgctgctcaagtctgctaggtctatctcttatgtctacggatcggactaagtccncgtacgtcgcaacgaccacgacccaccgtactcgacctaccg

SEQ ID NO: 417722 - DNA, 807 bp, Homo sapiens
  misc_feature: GZ8MTXP02GLTS9.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgattggttagaattctaacttgtctcctgtaccaacatacaaccaaactaacgacccccaaactcactactatttatagactacgacctaacgtaacggccggacccgttacgtaggggttttactaaacgtccggtcctttccgtaccgttcggggtaccttacccgtaaacgtttccgtacgggaccctaacccgtaccggggtacccccttaccccgttacggtaaaccctaaacgtttccttaccggttcggggtacccgtcccgtaaacggggtccgttacgggaaacggggaacggtacgggtacgtaacggttaactttaaaccgttaacgtcgtaccgttcgtacccttacttagttaacgtacgtaccgtaacgggtttccttaaacgtttcctttaacgtttacgttacggtttaccgtttacgggtaaaccgtttacggggaaacccggttaaacggttacccgtaacccgggttaccgttaaccggggttacccgtaaaccggtacccccgtaaaacccggaccccctaaaaccccctacggttacccttacccggtttaacccccg

SEQ ID NO: 417723 - DNA, 580 bp, Homo sapiens
  misc_feature: GZ8MTXP02JYPNR.19.78.H01.1.454.CMB.2.raw
  modified_base (422)..(422): a, c, t, g, unknown or other
  modified_base (451)..(451): a, c, t, g, unknown or other
  modified_base (475)..(475): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattctaaccttgtctctggtaccaacatcaacccaaataaacgcccccaaactcatcatttatgatgccactaacgcggccctcgtagggtttctaatcgtcttctcctggcctctaagtctggacacgaccggccctcccgtgaacctatcctcgtcgggcctccgaggtctggaaggacgnggctagtaacttacgtacgtgctgcctanattatgactagggttctatcgttntttagtcgttcgttacggaacgttcgggaaccgtaacggtcctaccgtcgtacggtacaaccgaccccgaaacggccccaaaccccgtcgtacgtaccttacccg

SEQ ID NO: 417724 - DNA, 674 bp, Homo sapiens
  misc_feature: GZ8MTXP02IVR3P.19.78.H01.1.454.CMB.2.raw
  modified_base (260)..(260): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttagaattctacttgtctctgtacanatacaccaaataacgaccccaactcatctatttatgatcgaccaactaacggccggtacccttacggtacggggtttacctaaagttccgtctttcgtccgtcggtcctaccgtaagttccgtacggacctaccgtacccgggtacccttacccgtacgtaaacctaacgttccgttcggtacgggcccttacccggaggtccgtagggaacgggacggtagggtacttaacggtaactttacctacgtggtaccttcggtaccttagtattacgtgtaccgtaacggttcgttacttctttacgttagttccgttacgttaccggaacgtcgggtaaacctaacggtccgtaccgtaccgttacggacaaccgaacccgaacggtacccccaaacctcgtaccgtacctaccg

SEQ ID NO: 417725 - DNA, 554 bp, Homo sapiens
  misc_feature: GZ8MTXP02F86YG.19.78.H01.1.454.CMB.2.raw
  modified_base (454)..(454): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaacttgtctcctggtaccaacatcacccaaataaacgccccaaactcatcatttatgatgccactaagcggccctcaggggtttctaaactcgctttctcctggctccaagtctggcacacggccctccctagacaatctctgggctccaggctggaggacgaggctgattactactgctgctacatagtgcgtaggttcgtatctnttactgttcttacggaacgtggggaacctaaaggtcctaccgttcctaagggtccaacggtacccaaacggccccaaaccccgtactacggtactaaccc

SEQ ID NO: 417726 - DNA, 547 bp, Homo sapiens
  misc_feature: GZ8MTXP02GFBTC.19.78.H01.1.454.CMB.2.raw
  modified_base (450)..(450): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttgaaattcaacctgtctctgtaccaacatcacccaaataaacgcccccaaactcaatcatttatgatgccactaagcgccctctaggggtttctaatcgcttctcctgctccaagtctggcacacggctcctgacaatctctgggctccgagctagaggacgtagctagatttacacgtgctgtctacatactgaccagggtcttatcctttnttagtcgttacgttacggacgtcggacctaacggtcgtacccgtcgtacggtaccaaccgacccgtaaacgacccctaaccctacgtcgtacctacg

SEQ ID NO: 417727 - DNA, 571 bp, Homo sapiens
  misc_feature: GZ8MTXP02HCTBH.19.78.H01.1.454.CMB.2.raw
  modified_base (276)..(276): a, c, t, g, unknown or other
  modified_base (295)..(295): a, c, t, g, unknown or other
  modified_base (417)..(417): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcggtcaccatctcctgcactggaaccagcagtgatgttagaattctaacttgtctctgtaccacatcaccaaataacnccccaaactcatcatttangatgaccactaagccgccctcgtaggggtttctaatcgtcttctctgctcaagtctgcacacgcctcctgacaatctctggcctcgagctgagacgaggctgtacttacacgtgctgcctanatagcgacgtacggtcttaattcttactttagtacgttccggttaacggaaacgttacggggaaacccgtaaggtaccctacccggttaccgtacggttaccaaccggaccccgaaaccggacccaacccccacgttaccgtacctaacccccg

SEQ ID NO: 417728 - DNA, 619 bp, Homo sapiens
  misc_feature: GZ8MTXP02HRZKL.19.78.H01.1.454.CMB.2.raw
  modified_base (223)..(223): a, c, t, g, unknown or other
  modified_base (261)..(261): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctctggacagtcgtcacatctcctgcactggaaccngcagtgatgttagaatctaacttgtctcctgtaccaanactacaaccaaataacgaccccaaactcaatcatttaatgatgacctaagtaacgccggtccctgtacgggtttactaaactcgcttctcctcggctacctaagtcgtacggacaaccgtaccggtccctaccctagaactaactctccgtcggctccgaggccgagaggacgacggtctagtacttactacgtcgtctctcttactatacgtcgacgtacgtacgtacttacgttacttacgttacgttacgttaccggtacggtaacggtaaccgtaaccggtaaccgtaccgtaccgtacgtaccgtaaccgaacccgaacccgacccgtaacccgtaccgtaccgtacctaccg

SEQ ID NO: 417729 - DNA, 712 bp, Homo sapiens
  misc_feature: GZ8MTXP02JPSED.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtcctcctggacagtcggtcaccatctcctgcacgtggaaccagcagtgatgttaggaaattctaaccttgtctcctgtaccaacatacaaccaaataacgaccccaaactcaatctatttatgtatgaccataacgcggtccctcgtagggttctaactcgtcttctccgtcggtcctaccgtaagtcgttacggaccaccgaccggtccctaccctacgaacctaactccgtccgtcgggtaccctcccgaaggccgtaggaacggtacggacgggtacttcggtaaacgtttaccctaacgttcgtccggttacgttaccgtaccgtaacttaggtacggtacgttacgggtttaccgttaactttccgtttatttaaccgttggttacccgttacggggtaaaccgtttacgggaaaccccggtaaaggtaccccgttaacccggttaccgtaacggttacccgaaccggtaccccgaaaccggtaccccctaaacccgtaacgtcccgtactttaacccccg

SEQ ID NO: 417730 - DNA, 707 bp, Homo sapiens
  misc_feature: GZ8MTXP02IU9SU.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacaggtcggtcaccatctcctgcactggaaccagcagtgatgttagaaattctaacttgtctctgacacatacaccaaataacgaccccaaactcatctatttatagatacgaccaactaacgccggtaccctacgtagggtttactaaagtccgtactttctaccgtcgcctaccaacgttctacggaccacgaccggtccctccctagacctaactctcgtcggggtcctaccgaggtcgtaggaacgggacggtacggtacttacggtaaacttaccttaaccgttggtccttacggactttacgtaacttacggtacgtacgttaacgggttaccgtttacgttacctttactttaacgttcgttaccggtttaaacgggtaaaccgttcggaacccggtaaaccgtaaaccgggttccgtaaccccggttccggttaaacggtaaccgtaaccggtacccccgtaaaccggacccctaaaacccccgttcgtaccggtttaaccccg

SEQ ID NO: 417731 - DNA, 789 bp, Homo sapiens
  misc_feature: GZ8MTXP02HOLUE.19.78.H01.1.454.CMB.2.raw
  modified_base (267)..(268): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttaggaattctaacttgtctcctgtaccaacatacaaccaaataaacgccccaaatcatctattannatcgacactacgccgtcctcgtaggttcaatcgtcttctcgtcggtacctaccgtaagtcgtacggaccaaaccggccggtccctacccgtacgaacctaacttccccgtaccgtcggggtccctaccggaggtaccgtacgggaccggggaaccggtaacggtcgttaacgttaacttaaccgtacgtccgtacgtcgtaccttacaagttacgttacgaccgttacggggttacctttaacttcctttacgtttagttaccggtttaccggttaaacgggtaaccggttaaccggggtaaccgtaaccgggggttacccctaacccgggtttaccgttaccggtaaccgaacccggtaaaccccgaaacccggtaaccccctaaaccccgttaacggttccgtacccttaaacccgtttccccgttacccctttaccccccgacccctttaccccgaaccgtaaaccggtacggtaaacccgtttacggaccggaacggggtccggaaccgtaccgggg

SEQ ID NO: 417732 - DNA, 534 bp, Homo sapiens
  misc_feature: GZ8MTXP02JQP50.19.78.H01.1.454.CMB.2.raw
  modified_base (227)..(227): a, c, t, g, unknown or other
  modified_base (251)..(251): a, c, t, g, unknown or other
  modified_base (260)..(260): a, c, t, g, unknown or other
  modified_base (327)..(327): a, c, t, g, unknown or other
  modified_base (417)..(417): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcacctctcctcactcaggacacagggtcctgggcccagtctgccctgactcagtctgcctccgtgtctgggtctcctggacagtcggtcaccatctcctgcactggaaccngcagtgatgtgaaattcactgtcnctgtacacntcaccaataacgccccaaatcatcatttatgatgccactaagcgccctcagggtttcaatcgcttcncctgctacagtctggcacaccggctaccctgacagtctctggcctccgagctggacgacgacgggctaggaactttcacgttgcgttacnctacattacgcgacggtacgttcttactccttactttacgtcgttacgttacggaacgtcggaacctacgtcaccgtcgtacgacaacgacccgaacgacccaccgctacgtacacg

SEQ ID NO: 417733 - DNA, 654 bp, Homo sapiens
  misc_feature: GZ8MTXP02IO6S4.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctctgtacaacatcaaccaaataaacgaccccaaatcaatcatttactgatgaccaataagccggtaccctagtaggggtttactaaactcgtacttcgtacctcgcctccaagtctggacaccgacgccctaccctagaaccaactctcgtcggctacgtaggcgtggacggacgaggtctagtaacttacgatcgacttgacttacaatacgtcgacgtacggttacgtaactcttacgttaacgtcgttaccgttacggtaacgtacggggtaaaccctaaacggggtacccttaaacccgggttaccgttaaacggtaccgtaaacccggtaaccccggaaaaccgggttaacccccaaaacccccgtacggttacccgttaaaccgtttacccccg

SEQ ID NO: 417734 - DNA, 721 bp, Homo sapiens
  misc_feature: GZ8MTXP02ILWDH.19.78.H01.1.454.CMB.2.raw
  modified_base (267)..(267): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctctgtaccanatacaaccaaataaacaccccaaactcatctattatagatcgaccactaaacgccgtacccgtacgtacgggtttactaacgtcgtcttctcgtcgtcctacctaagtctacggaccaccgtaccggtcccctacccgtacgtaacctaacgttccgtccggttacggggtcctacccggtaacgggtccgttacgggaaaccgggggtaaccggaacggggtacccttagggttaaacgtttaaccctaaccgttacgggtccttacggtaccttaccgtaattacgtacgtaccgtacggtttacgttacttcgtttacctttaagttcgttaccgttacgggtaaccgtacgggaaacccgtaaacggtacccgtacccgttaccgttaacggaccaaccggaccccgaaaccggaccccctaaacccgtaccttacgtaccttaaccccg

SEQ ID NO: 417735 - DNA, 625 bp, Homo sapiens
  misc_feature: GZ8MTXP02I9U1X.19.78.H01.1.454.CMB.2.raw
  modified_base (425)..(425): a, c, t, g, unknown or other
  modified_base (472)..(472): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtccctggacgagtcggtcaccactctcctcgcactggaaccacgcagtgatgttggtaatctaaccttgtctcctggtaccaacatcacccaaataaacgacccccaaacctcactcatttatgatcgccactaagccggcccctcgtaggggtttccttaaactcgtccttctccgtggtcctcctaaacgtctggaccaaccaccgggccctccctgacaactctcgtcgggctcccnggctggaggacgaggcctagtacttactactgctgctactatagtcncgagggttcctattcttactttagtcgtacgtttaccgggtaacgtcggggtaaacccaaggttcccgtaccggtttaccgaaacgggtccaaccggaacccccaaaacggggacccctaaaaccccctcgtcggtacctaaccgtttccccg

SEQ ID NO: 417736 - DNA, 645 bp, Homo sapiens
  misc_feature: GZ8MTXP02F08L1.19.78.H01.1.454.CMB.2.raw
  modified_base (262)..(262): a, c, t, g, unknown or other
  modified_base (298)..(298): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatggttgaaacttctaactgtctctgtacanactcaaccaaataacaccccaaactcatctatttangactacgaccaactaacgccggtaccctacgtacggggtttactaaagtccgtctttactcccgtcggtacctacctaacggtcgtacggaaccaccgtaccggtccctaccgtacgactaactcgtcgtcgggctcccgagcgtaggagacgaggctagtacttacacgtgctgtactctagtactaggacgtacgggttcttaacttcgttactttaagttcgttacgttaccgggtaacggtacgggaaccgttaacggtacctaacccggttacgtaacggtaccgtaacggaaccccgtaaaccggtaccccaaaaccccgtacgtccgtacgttaaccccg

SEQ ID NO: 417737 - DNA, 860 bp, Homo sapiens
  misc_feature: GZ8MTXP02GJJSU.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcacgtggaaccagcagtgattgttaggaaattctaacttgtctcctggtaccaacactacaacccaaataaacgaccccaaactcatactactttatgatcgaccaacgtaaacggccggtccctacgtacggggttttacctaaacgtccgtactttacctcccgtcgggtcctacccgtaaagttcgttacggaccgtaaccgtacccgggtacccttaccccgttacggtaacctaaacgtttcccgttccggttaacgggggtccctttacccggaacggggtccgttacgggaaacgggggtaaccggtaacggggtcgttaacgggttaaacttttaaacccgtaacgtttccggtaaccgtttcgggtaccctttacgtaacgtttaaacggttcggtaccggtaacggggtttacccggtttaaactttcccgtttaccgttttaaacgtttccggtttaacccggttttaccggggtaaaacccgggttttaccggggaaaaccccgtttaaaaaccgggggttccccgttaaccccgggttaacccgtttaaccgggggttaacccaaccgggttaacccccgaaacggttacccccgaaaacccccgtaccgtttaccggtacctttaaccccgg

SEQ ID NO: 417738 - DNA, 638 bp, Homo sapiens
  misc_feature: GZ8MTXP02HEY32.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctggtacaacatcaaccaaataaacgaccccaaactacatactatttatgatcgaccaacgtaacgccggccccttacgtacggggtttacctaaagttccgtccgtttctcccgtagggtccttacccaaaggttccgtaggaccaccgaccgggtccctcccgttagaacctaactcctcgtcgggtcctcccgacggcgtggaggacgaggtctagtactttactacgttgccgtgctctatagtgacgaggttcgtattcttacttgttacgttcgttacgggtaacgttaggggaacctaacggtaccgtacccgttaccgtacggtacaacccggacccaaacgggaccccaaccccgtaactccgttacctacccg

SEQ ID NO: 417739 - DNA, 596 bp, Homo sapiens
  misc_feature: GZ8MTXP02F05V1.19.78.H01.1.454.CMB.2.raw
  modified_base (198)..(198): a, c, t, g, unknown or other
  modified_base (227)..(227): a, c, t, g, unknown or other
  modified_base (250)..(250): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccngcagtgattgtgaaattctactntctctgtacacatcaccaaataacgaccccaaactcatactatttatgatcgaccactaacgcgccctacgtagggtttactaactcgtcttctcctcggtcctaccgaagtctcggacaccgaccggtccctcctagactaacgttctcgttcgggccttccgacggcgtaggaaggacggtaggctagtactaacgtctggtctgtccttatagtacgtacgtacgtacgtacttacttcttacgttacgtcgttacgtacggtacgtacggaccgtacgtaccgtaccgtacgtacgaccgtaaccgaaccgaaccgtacccaaccgtactaccgtacctacg

SEQ ID NO: 417740 - DNA, 552 bp, Homo sapiens
  misc_feature: GZ8MTXP02IH64U.19.78.H01.1.454.CMB.2.raw
  modified_base (213)..(213): a, c, t, g, unknown or other
  modified_base (231)..(231): a, c, t, g, unknown or other
  modified_base (411)..(411): a, c, t, g, unknown or other
  modified_base (421)..(421): a, c, t, g, unknown or other
  modified_base (426)..(426): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctccngcactggaaccagcagtnatgttagaaattctaacttgtctctgtacaacatcaccaaataagaccccaaatcatcattatgatgacactaaagcgccctctaggggttctaaatcgtcttctcctggctaccaaggtctggacaacgaccggtcctcccgtagaacctaatctctggctcagctcgagacgagcgtnatacttaacngctcnctatatatagtacgacgtacgtacttacttacttactcgttacgttacggtacgtacggtaacgtaacgtaccgtaccgtacgtacgtacgaaccgaccgaaccgaccaaccctactacgtactac

SEQ ID NO: 417741 - DNA, 591 bp, Homo sapiens
  misc_feature: GZ8MTXP02I3B19.19.78.H01.1.454.CMB.2.raw
  modified_base (198)..(198): a, c, t, g, unknown or other
  modified_base (227)..(227): a, c, t, g, unknown or other
  modified_base (249)..(249): a, c, t, g, unknown or other
  modified_base (259)..(259): a, c, t, g, unknown or other
  modified_base (292)..(292): a, c, t, g, unknown or other
  modified_base (296)..(296): a, c, t, g, unknown or other
  modified_base (433)..(433): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgcctgactcagtctgcctccgtgtcgtggtctccgtggacngtcggtcaccatctctgcactaggaaccngcagtgatgtagaattctactntctctgacanatacaccaataacaccccaactcatactattangatnacactaacgccgcctcgtagggtttcaatcgtcttctccgtcgctaccgaagtctacggacaccgccggtcctccgcaactactctcgtacggcctccgagtacgtaggaaggacgaggtcttaagtactttaaacncgtcggtacttgaccttagattagtacgaccgtagggttactacttcgttacttgttcgtacgttacgggtaaacgtacgggtacgtaaacggtcccgtaccgtaccgtacgtaccgaaccgacccgaaccgtaccccaaactcgttaccactacccg

SEQ ID NO: 417742 - DNA, 509 bp, Homo sapiens
  misc_feature: GZ8MTXP02FIZQQ.19.78.H01.1.454.CMB.2.raw
  modified_base (225)..(225): a, c, t, g, unknown or other
  modified_base (373)..(373): a, c, t, g, unknown or other
  modified_base (478)..(478): a, c, t, g, unknown or other
  modified_base (499)..(499): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttgaaattctaactgtctctgtaccaacatcaccaaataaacgaccccaaactcatcatttatgatgccactaagccggccctacgacggggtttctaaatcgctttctcctggctcaagtctgcacaccggcctcccngacaatctctggctcagctggaggacgaggcgtgtacttactacgtcgctgctacatatgcgtaggtcgtatctcttatgtctcgaacgtgactagcaccgtacngtacaagccaacgccaacccnctcgactacc

SEQ ID NO: 417743 - DNA, 689 bp, Homo sapiens
  misc_feature: GZ8MTXP02JB5BG.19.78.H01.1.454.CMB.2.raw
  modified_base (264)..(264): a, c, t, g, unknown or other
  modified_base (274)..(274): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttaggaattctaaccttgtctctgtacanatcaccaaanaacgaccccaaactcatactatttatgatgaccaactaacgccggccctcgtaggggtttactaagtccgtcttcctcgtcggtcctaccgtaacgttcgtcggaccaccgaccggtccctacccgtcgaacctaatccttcgtcgggccttacccgaggccgtaggacggacgacggtctagtacttacctagtcggtctcgtactactaagttacgtacgacgtaacgggttcgttaactttcttacgtttacgtacggtttaccggttaaccgggtaacggttaccggggtaaacccgtaaacgggttacccgttacccggttacccgtttacggtaacccgtaaccggtaaccccggaaaccgggtaaccccctaaaacccccgtacgttaccgtaacccgtttaaccccg

SEQ ID NO: 417744 - DNA, 792 bp, Homo sapiens
  misc_feature: GZ8MTXP02I8GV6.19.78.H01.1.454.CMB.2.raw
  modified_base (229)..(229): a, c, t, g, unknown or other
  modified_base (265)..(265): a, c, t, g, unknown or other
  modified_base (282)..(282): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtcctccgtggacagtcggtcaccatcctcctgcacgtggaaccngcagtgatgttagaaattctacttgtctctgtacanatacaaccaaataaacnccccaaatcatactaattatagtactcgacctaacgtaacgccgtaccccggggggttactacggggttttacctaaacgttccgtacctttaccgtcccgttcggtaccttaccgtaaacggttcgtaaccgggaaccctaaccggtcccgggtacccccttacccgtaacgtaaccctaaacgtttccgttccgggtaccggggtacccttacccggaaggggttacccggttaacggggaaaccggggtaaccggtacggggtaacctttaacggttaacctttaaaacccgtcgttacggtcccgttaggtaaccccttagtaacgttacgtaccggtaccgttaacgggttccgttactttaccgtttacgtttaacgtcgtttaaccggttaaaacgggtaaacggttacgggtaacccgtaaacggttcccgtaccggttaccgtacggtaccaaccggacccgaaaccggacccctaacccgtacgtacgtacccttacccg

SEQ ID NO: 417745 - DNA, 644 bp, Homo sapiens
  misc_feature: GZ8MTXP02H2YXT.19.78.H01.1.454.CMB.2.raw
  modified_base (431)..(431): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatcctctgcactggaaccagcagtgatgttagaattctaacttgtctctgtacaacatacaacccaaataacgaccccaaactcactcatttatgatcgacactaagcgccctactacggggtctactaactcgtcttccctcgtcggtctaccgtaagtcgttcggactaaaccgacggtaccctccgtacgaacaacttctaccgtcggccttaccgaacgcgnggacgggtaacgaacggtcgtacgttaacttaacctaacgtcggtactaggtccctttaatacgtacgtagtaccgtacgttacgttacttaccgttacgtttacgtacggttacgtaacggtacgtaacggtaaccgtaacggttacccgtaccgttaccgtacgtaaccgaaccgtaaccgacccgtaaccctacccgtacgtaccgtacc

SEQ ID NO: 417746 - DNA, 679 bp, Homo sapiens
  misc_feature: GZ8MTXP02JBNGE.19.78.H01.1.454.CMB.2.raw
  modified_base (196)..(196): a, c, t, g, unknown or other
  modified_base (300)..(300): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgttaggaaattctaaccttgtctctgtaccacatcaaccaaataaacgccccaaactcatctattangatcgaccactaacgcgccctcgagggtttcaatcgcttctcctcggcctacaagtcgagaccactccggcctcctacgaactaactccttcgtcgggtcctacccgtaggcgtaggaacggacgaagggccttaaggtactttaaaccgtacgttagccgttacggacttacccgtaattaacgttcggacgttaacgggttacgtttaacgttacttccgtttagttacgtttaccgttaacgggtaaaaccggttaggggtaaacccgtaaaacggggttccctaaacccggttccgttaaacggttacccgaaccgtaacccccgaaaccggggaaccccctaaaaccccgtactttacggtacccttaaccccg

SEQ ID NO: 417747 - DNA, 593 bp, Homo sapiens
  misc_feature: GZ8MTXP02IN51N.19.78.H01.1.454.CMB.2.raw
  modified_base (226)..(226): a, c, t, g, unknown or other
  modified_base (388)..(388): a, c, t, g, unknown or other
  modified_base (418)..(418): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccngcagtgatgttagaaattctaacttgtctctgtaccacatcaccaaataacgacccccaaactcatactatttatgatcgaccactaagccgccctacgtagggtttctaatcgtcttctcctgctcaagtctgcacacgcctcctagactatctcgcggcnccgagctaggagacgacgtctgtacttacnctgctagactctatagtacgaccgtaaggttctacttcttacgtttaacgtcgttacgtttacgggaacgttacggggaacccgtaaacggtcccgtaacccggttaccgttacgggttaccaaccggtaccccgaaacggacccctaaaacccctacgttccgttacctacccg

SEQ ID NO: 417748 - DNA, 858 bp, Homo sapiens
  misc_feature: GZ8MTXP02JK6LU.19.78.H01.1.454.CMB.2.raw
  modified_base (227)..(227): a, c, t, g, unknown or other
  modified_base (233)..(233): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtnatgttgaaattctaacttgtctctgtacaacactcaaccaaataaacgaccccaaactcatctatttatgatcgaccaactaacgccggtaccctacgtacggggttttactaaacgttccgtcctttacgtccccgttcgggtccttaccctaaacggttccgttacgggaccctaacccgtacccggggtcccccttaacccccgttagaaacccttaaaacttcccgttaccgttcccgggggtaccctttacccccggaaacggggtccgttacgggaaacgggggtaaacccgaaacgggggtcctttaagggtaaacttttaacccgtaaccgttccgggtaccttacgggtccctttaacgtaaacctttaagttaccggtaccgtacgggggtttaccgttaacgtttccgtttaccgttttaaagttcgggtttacccggttttaaaccgggggtaaaccggtttaaccgggggaaaaccccgttaaaacgggggtttaccccgttaaaccccggggttacccgttaaaccgggggtttacccaaccgggtaacccccgtaaaaccggggtcccccaaaaacccccgtccgtttaccggtacctttaaccccccgg

SEQ ID NO: 417749 - DNA, 617 bp, Homo sapiens
  misc_feature: GZ8MTXP02G80C2.19.78.H01.1.454.CMB.2.raw
  modified_base (307)..(307): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtgtatgttaggaaattctaaccttgtactcctgtaccaacatacacccaaataacgccccaaactcatcatttangatgccaactaacgcggccctcgtagggtttcaatcgcttctcctggctcagtctcggcacgccgcctcctagacatctcgtgggctccgaaggtcgtaggacggacggacgcgtagtacttacgtactggccttgccttacaattgtacgacgtaaggtttctaacgttccttacgtttagtcggttaccgtttaaacgggtaccgtacgggggtaaacctaaacggtcccgtaacccgttaccgtaaggggtacccaacgggacccctaaaccgggcccaaaacccccgtttcgtaccgtacctaccg

SEQ ID NO: 417750 - DNA, 851 bp, Homo sapiens
  misc_feature: GZ8MTXP02IXKGC.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctacttgtctctgtacaacatcaccaaataaacgcccccaaactcatctaatttatgatcgacccactaaacgccggcccctacgtaggggttttacctaaagttccgtctttcttcctcggccttacctaacgttcttacggaccaccgaccgggtccccttcccgtacgaacctaaacttccgttcgtcggggtcctacccgaacgggcgttacggaacggggacgacgggtctacggttaactttaccgttaacgttacggtccgttacggtaccgttactaacgtttacgttacggtacccgttaacgggggtttacccggtttaactttacccggtttacctttttaacgtttaccggggtttttaccccggtttttaaaacccgggggtaaaacccgggtttaacccggggggttaaaaccccggttaaaaccggggggtttacccccgttaaaacccccggggtttaaccccggtttaaacccgggggtttaacccggtaaaccccgggaaacccccccgggttaaaacccgggtaaccccccccgtaaaaccccccgtttaaacccggtttacccgggtttaccccgttttaaaccccccg

SEQ ID NO: 417751 - DNA, 529 bp, Homo sapiens
  misc_feature: GZ8MTXP02JBOUD.19.78.H01.1.454.CMB.2.raw
  modified_base (261)..(261): a, c, t, g, unknown or other
  modified_base (296)..(296): a, c, t, g, unknown or other
  modified_base (354)..(354): a, c, t, g, unknown or other
  modified_base (517)..(517): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgccactggaaccagcagtgatgtgaaattctaactgtctctgtaccanatcaccaaataaacgcccccaaatcaatcatttangatgccactaagcggccctgaggggtttcaatcgcttctcctgctcaagtctggcacncggcctcctgacatctctggctccgagctgaggacgaggctagtattactagttgcttgcttacattagtgcgtaggtctaatcttcttatcgtcgttacggaactgggaaccctaaggtcccacgttacctaggtaccaacggacccaacggcccaaacccnctcgtactaccg

SEQ ID NO: 417752 - DNA, 555 bp, Homo sapiens
  misc_feature: GZ8MTXP02FOYA7.19.78.H01.1.454.CMB.2.raw
  modified_base (277)..(277): a, c, t, g, unknown or other
  modified_base (424)..(424): a, c, t, g, unknown or other
  modified_base (457)..(457): a, c, t, g, unknown or other
  modified_base (468)..(468): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaactgtctctgacacatcaccaaataacnccccaaactcaatctatttatgatcgaccaactaacgccggccctacgtaggggtttactaactcgtactttctctcggctcaagtctcgacaccgaccggcctccctgactaatcgtacgtcgggctccgaggctaggacggacgnggctagtacttactctagctgctcatatgacgngtcgtatcttntattcgtcgtacggtaagtcggaactacggtctaccgtcgtagtccaacgacccgtaacggaccctaaccctactacgtactacccg

SEQ ID NO: 417753 - DNA, 708 bp, Homo sapiens
  misc_feature: GZ8MTXP02IU4GH.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtagtcaccatctcctgcacgtggaaccagcagtgatgttagaaattctaacttgtctctgtacacatcaaccaaataacgaccccaaatcaatctattatagatcgaccactaacgccggtcccgtgtacggggtttctaaacgtccgtacctttcctccgtcggtccttaccgaagtccgtacggacctaccgaccgggtccctcccgtagtaacctaattccgtcgtcggggccttaccgaaggtcgtaggaacggaacgtcgggtacttacggtaaactttacctaacgtcggtaccttcggaccctttaggtaactttaagcggtacccggtaagggttccgtttacgtttaacctttcgtttaaacgttcggtttacccggtttaaacgggaccggttacggggaacccggttacgggtaccgttaaccccggttaccgtacggttacccaaccggtaacccccgaaacggtaccccaaaccccggttatccggtaccttacccg

SEQ ID NO: 417754 - DNA, 623 bp, Homo sapiens
  misc_feature: GZ8MTXP02HFUW2.19.78.H01.1.454.CMB.2.raw
  modified_base (199)..(199): a, c, t, g, unknown or other
  modified_base (268)..(268): a, c, t, g, unknown or other
  modified_base (437)..(437): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctccgtaggacngtcggtcaccatctcctgcactggaaccagcagtgattgttagaaacttctaacttgtctctgtaccanactaccaaccaaactaaccgaccccaaatcatctaattatagactcgacctacgtaacgccgtacccgtacggttaagggtttctaaactcgtctttctcccgtgcctacagtctacggacacgccgtcctcctgactatctcgtcgctccgacgcgtaggacggacgnggtctacggtaacttacgtacgtcgtctacgtctataaacgtgtacgccgtacggtttaccttattcttacgttacgttacgtaccggttacggacgttacgggaaaccgtacgtccgtaccgttactaccgggtaccaaccggacccgaaaaccggccctaaaaccctcgtaccgtccttacccg

SEQ ID NO: 417755 - DNA, 533 bp, Homo sapiens
  misc_feature: GZ8MTXP02GC8QA.19.78.H01.1.454.CMB.2.raw
  modified_base (448)..(448): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaaattctaactgtctctgtaccaacatcaccaaataacgaccccaaactcatctatttatgatgccactaacgccggccctcaggggtttactaatcgacttctcctgctacaagtctgcacaccggcctccctagacaactctctcggctccaggctgaggacgaggctagattactactggtctgctcatatgacgtaggtcgtatctnttagtcgtcgttacggaacgtaggaccgaacggtctaccgtctacggtcaacgacccacggacccaacccgactaccgtctaccc

SEQ ID NO: 417756 - DNA, 548 bp, Homo sapiens
  misc_feature: GZ8MTXP02FVF0F.19.78.H01.1.454.CMB.2.raw
  modified_base (265)..(265): a, c, t, g, unknown or other
  modified_base (436)..(436): a, c, t, g, unknown or other
  modified_base (450)..(450): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttggaaattctaacttgtctctgtaccaanatcaccaaataaacgcccccaaactcatcatttatgatgccactaagccggccctcgaggggtttctaatcgacttctctcggctaccaagtctcggacacgaccggccctccctagactaatctctgggcctccgagctgagacgagctgattactatgctgctcattangcaggtctattctnttatcgtcgtttacggaacgttcgggaaccgtaaacggtcctacccgttacctaggtccaacgaccccaacggacccctaacccacgtctactacccg

SEQ ID NO: 417757 - DNA, 624 bp, Homo sapiens
  misc_feature: GZ8MTXP02J0WB0.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaacttgtctcctgtaccaacactacaccaaactaaacgaccccaaactcatcatttatgatgaccactaacgccggaccctacgtaggggtttactaaagtccgtctttctcccgtggccttaccaagttcgtcggacaccgaccggtccctccctgaactaactctcgtcgggtctccgaggtcgtggaacgggacgacggtactagaacgtttactacgtggcttagcctatattacgtggtcacgggttctacttcttaccgttattcgttaccgttacgggaaacgttcgggaacccgtaaggggtcctacccgtaccgtacggtaccgaacggaccccgaaacggacccctaaccccacgtaccgtactacccg

SEQ ID NO: 417758 - DNA, 564 bp, Homo sapiens
  misc_feature: GZ8MTXP02IE5KZ.19.78.H01.1.454.CMB.2.raw
  modified_base (309)..(309): a, c, t, g, unknown or other
  modified_base (337)..(337): a, c, t, g, unknown or other
  modified_base (359)..(359): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatggttggacttatacccttatctcctggtaccaacaactaccccggacaaacgcccccaaaactccctgtactttangagctcataacgcgcctcgagggtttcngacgcgcttctctggcctccgngggctgaacacacggcctactgacgtactctcgtgggctccgagcgtggaggacgaggctgacttattatgctgcgcatacgcgtaaggaagtacgaccagagtgggtgtaggcgggcgggacggaccgagggtacgtaccggtccgtcgggtacgacgtccgaacggcctccggcccccgtcggtcctaccgtccgtttacccg

SEQ ID NO: 417759 - DNA, 547 bp, Homo sapiens
  misc_feature: GZ8MTXP02GVJJP.19.78.H01.1.454.CMB.2.raw
  modified_base (196)..(196): a, c, t, g, unknown or other
  modified_base (223)..(223): a, c, t, g, unknown or other
  modified_base (259)..(259): a, c, t, g, unknown or other
  modified_base (272)..(272): a, c, t, g, unknown or other
  modified_base (394)..(394): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctggcccagtctgccctgactcagtctgcctccgtgtctggtctcctggacngtcgtcaccatctcctgcactgaaccngcagtgatgtgaattctaacttgtctctgtacaacntcaccaaataacnccccaaatcatctatttatgatgccaactacgcgaccctgtagggtttcaatcgcttctctgcctacagtctcggcacgacgtcctcctgactatctcgcggctccgagcctaggacgacgnggtctagtacttacacgttgctgctacatagtcgactaaggttctattcttactttagtcgttacgttaccggtaacgtcgggtaacctaaacggtccgtaaccgtccgtaggtccaacgacccgaacgtacccaaccctgtcctactacccg

SEQ ID NO: 417760 - DNA, 637 bp, Homo sapiens
  misc_feature: GZ8MTXP02HI0FG.19.78.H01.1.454.CMB.2.raw
  modified_base (376)..(376): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaaattctaaccttgtctctgtaccaacatcaaccaaataaacgccccaaactcatactatttatgatgccaactaacgcggccctcgtagggtttctaatcgtcttctcctgctcagtctggcacacggcctcccngacaactctcgtcgggcctcccgaggtcctaggacggacgtagggacctggaactttacgtactcggacttcgacttacaatacgttgccgtagggttacttaattccttaactttagttcgttaccgtttaccggaaacgttcgggggtaaaccctaaacgggttcccgaaacccgttccgttaacgggtacccgaacgaacccccggtaaaacggaccccctaaaacccccgtacgtttcccggtacctttaacccccg

SEQ ID NO: 417761 - DNA, 580 bp, Homo sapiens
  misc_feature: GZ8MTXP02IZDRQ.19.78.H01.1.454.CMB.2.raw
  modified_base (262)..(262): a, c, t, g, unknown or other
  modified_base (463)..(463): a, c, t, g, unknown or other
  modified_base (469)..(469): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctcgtgtctggtctcctggacagtcggtcaccatctctgcactgaaccagcagtgatgttaggaaattctaacttgtctctagtacanatacaaccaaataacaccccaatcatactaattatgatgaccacgtaacgccgtaccctacgtacgggtttactaagtcgtcttcctccgtcgtcctacctaagtcgtacggaccaccgccgtccctaccgtacgactaactcgtacgtcgggctaccgagtcgtaggaacggtcgaaggctgtaattactgtgctgactnattagngacgtgtattctcttattagtcgttacgtacgtacgtacggaaccgtaacgtccgtacgtacgtacgaccaaccgaaccgaaccgtaccctaacctacgtacgtactaccg

SEQ ID NO: 417762 - DNA, 754 bp, Homo sapiens
  misc_feature: GZ8MTXP02HYBDW.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgcctgactcagtctgcctccgtgtctggtctcctggacagtcgtcaccatctcctgcactggaaccagcagtgattgttagaaattctaacttgtctctgtaccaacataccaaccaaaataacgccccaaactcatacaatttatgactcgacctaactaacggccggtaccctacggttaacggggtttacctaaacgttccggtactttccgtcccgttaggacccttaccgaaaggttcgttacggaccaacccgtaccgggtcccttaccccgttagaaacctaaacgttccgttaccggttcggggtacccttacccggaagggtccgtaacggggaacggggaaacgtaacgggggcttaaacgggttaaactttaccgtacgtaggtaccttcggacctttactaagtttacgcgggtaaacgttcgggtttaacccttattccggtttacctttaagtccgtttacggtaaccggtaaacggtttcggggaaaccctaaacgggttcccgtaacccgttaccggttaacggaccgtaaccggaccccgaaaacggaccccctaaacccctacgtcgtttaacccctccg

SEQ ID NO: 417763 - DNA, 626 bp, Homo sapiens
  misc_feature: GZ8MTXP02F6U5C.19.78.H01.1.454.CMB.2.raw
  modified_base (430)..(430): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcacgtggaaccagcagtgattgtagaaattctaactgtctctgtaccacatacaaccaaataacgaccccaaactcatctatttatgactgacctactaacgccggccctcgtacgggtttactaacgtcgtcttctccgtcggtcctactaagtcgtacggaccaccgccgccctcctacgactaactcgtcgtcggctccgagcgtgaggacgnggtctagtacttactacgtgtctcgtctagtagtactcggtacgtacgggtcttactttcttctttaagttcgttacgttaccggggtaaacgtaccggggtaaccgtaaaccggtcctaacccggttacgtaaccggttccgaaacccggaccccgtaacggacccctaaaccccgtcttaccgtacttaccccg

SEQ ID NO: 417764 - DNA, 601 bp, Homo sapiens
  misc_feature: GZ8MTXP02HD427.19.78.H01.1.454.CMB.2.raw
  modified_base (197)..(197): a, c, t, g, unknown or other
  modified_base (222)..(222): a, c, t, g, unknown or other
  modified_base (258)..(258): a, c, t, g, unknown or other
  modified_base (268)..(268): a, c, t, g, unknown or other
  modified_base (383)..(383): a, c, t, g, unknown or other
  modified_base (468)..(468): a, c, t, g, unknown or other
  modified_base (498)..(498): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcacatctctgcactgaaccngcagtgatgtagaaattctaacttgtctctgtacanatcaccaaanaacaccccaaactcatctattatgatcgcctaacgtaagccggtccctcgtaaggggtttactaattctcttactccgtgcctacctaagtctacggacaccggccgcctcccgngaactactccgtcgtcggcctccgaggcgtaggacggaaacgcgggtacttacgtaatttaccgtactcggtcttagccctttanagttagttgaccgtagggttctaattcttntttagttcgtccgtttacggacgtagggaaccctacggtaccgtaccgtaccgtacgtacaaccggacccaacggtaccccaaccctctaccgtcttaccccg

SEQ ID NO: 417765 - DNA, 634 bp, Homo sapiens
  misc_feature: GZ8MTXP02JDL57.19.78.H01.1.454.CMB.2.raw
  modified_base (313)..(313): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcggtcaccatcctcctgcacgtaggaaccagcagtgtatgttaggtaacttctaacttgtctcctagtaccacactaccaaccaaataaccgacccccaaatctatctatttanagtactcgacctaacgtacggcccggtcccttaggtacgggtttactagtccgtacttcgtccgtcggcctacgtaacgttctacggaccaccgaccgtccctacccgtagacctactccgtcgtcgtcctaccgagtcgtaggacggacgtaggtctagtacttacgtacgtcgtctcgtctatagttacgacgtcgtacggttcttacgttcttacgttattcggttacgtacgggtaacgtacgggaaccgtaacggtcccgtaccgttaccgtacgacgaaccgacccgaaccggccccaccgtactcgtactcccg

SEQ ID NO: 417766 - DNA, 701 bp, Homo sapiens
  misc_feature: GZ8MTXP02IWAD1.19.78.H01.1.454.CMB.2.raw
  modified_base (266)..(266): a, c, t, g, unknown or other
  modified_base (289)..(289): a, c, t, g, unknown or other
  modified_base (303)..(303): a, c, t, g, unknown or other
  modified_base (353)..(353): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcggtcaccatctcctgcacgtggaaccagcagtgatgtagaaattctacttgtctctggtaccanatcaccaaataacgccccaaacncatctattatgatnaccataagccgcctcgtagggtttctaatcgcttctcctgcctcaagtcngaccacaccggtcctacctgacaatctcgtggcctcgaggctaggaggacgcgctagaacttacgtactcggtctacggtacttacaacgttagtacgtacgtacgggggtttaacgtttaaccgttactttaccgttttaacgtttcggggtttacccgtttaaacccgggggtaaaaccgggtttaaccgggggtaaaacccctaaacgggggttaaccccttaaaccccgggtttaacccggttaacggggttaaccccgaaaccgggttaaccccccgaaaaccggggttaaccccccaaaaaccccccgtaaaccgtttcccggtaaaccctttaacccccgg

SEQ ID NO: 417767 - DNA, 728 bp, Homo sapiens
  misc_feature: GZ8MTXP02JNLME.19.78.H01.1.454.CMB.2.raw
  modified_base (224)..(224): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctctgcactggaaccngcagtgatgttagaaattctaacttgtctctgtacacatacaccaaataacaccccaaactcatctatttatgatcgaccactaacgccggccctacgtacggggtttctaactcgtctttctaccctcggtcctaccgtaagttcgtaggaccaaccgaccgggtccctacccgtacgaacctaacgtcctcgtcggggtcctaccggacgcgtaggacgggacgtacgggctacggtaacttacgtacgtacgtcgtacgtacttactagttacgttacggtaccgtacggggtttaccgttaactttcctttaccgtttaagtttacggttacccggtttaaccggggtaaaaccggttccgggggtaaacccggttaaaccgggttacccgttaaaccccggttacccggttaaccgggttaccgtaaacccgggtaacccccggaaaaccggtacccccgtaaaccccgtaccgttaacccggttaccttaacccccgg

SEQ ID NO: 417768 - DNA, 706 bp, Homo sapiens
  misc_feature: GZ8MTXP02FO7U1.19.78.H01.1.454.CMB.2.raw
  modified_base (195)..(195): a, c, t, g, unknown or other
  modified_base (298)..(298): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcacatctcctgcacgtggaaccagcagtgatgttagaaattctaactgtctctgacacatacaaccaaataacaccccaaactcatctattatagatnccactacgcgtaccctcgtagggtttactaactcgtcttctcgtcgtctacacgtctcggacacgaccgcctccagacaactctctgggcctaccgagctagaagggaccgaggtcgtagtaacgttaacgtcgtactccgtgacttacctaagttagtacggtaccgtacggggtttaacttccgtttaccttacgtttacgtacgtttacccggtttaaccggggtaaaaccggttacgggggtaaaaccccggtttaaaccgggttaacccggttaacccccgggtttaaacccgtttaacccgggtaaacccgtaacccgggaaacccccggttaaaaacccggggtaccccccaaaacccccgggttaaaccttaccccggtttaacccctttaaacccccgg

SEQ ID NO: 417769 - DNA, 572 bp, Homo sapiens
  misc_feature: GZ8MTXP02IP1CZ.19.78.H01.1.454.CMB.2.raw
  modified_base (449)..(449): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgttgaaattctaacttgtctctgtacacatcaaccaaataaacgaccccaaatcatctatttatgatcgaccaactaacgccggccctcgtacggggtttactaatccgtcttactcgtcgcctccgaagtctaggacacgaccgccctccctagactaactcgtctcgggctaccgaggtctggaagacgacggcttagtaacttactacgtgcttntctactagtagtacgtcgtagtcttacttcttactttagtcgttacgtacggtacgtacggtaacgtacgtccgtaccgtacgtacgtaccaacgacccgaacgaccccacctctctactacg

SEQ ID NO: 417770 - DNA, 598 bp, Homo sapiens
  misc_feature: GZ8MTXP02GCMZ0.19.78.H01.1.454.CMB.2.raw
  modified_base (452)..(452): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaactgtctctgtaccacatacaccaaataacgaccccaaactcaatcatttactgatgaccactaacgccgccctcgtaggggtttactaatcgtacttctcctgcctacaagtctaggcacgaccggcctcctagacaatctcgtaggcctccgagcgtagacgggacgacgggtctagtaacttacgtactagccgtgtcctanataacgtgaccgtaggtacttattccttacttattcgttccttacggtaaccgtacgggtaaccgtaaacggtacctaccgttaccgtaacgtccgaaccgtaccccgaaacggaccccaaaccccgtactacgtacctaaccccg

SEQ ID NO: 417771 - DNA, 767 bp, Homo sapiens
  misc_feature: GZ8MTXP02IIKH4.19.78.H01.1.454.CMB.2.raw
  modified_base (197)..(197): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcggtcacatctctgcactcggaaccagcagtgtattggttaggaaattctaactttgtctctgtaacaacactacaaccaaactaaaccgaccccaaactcaatactaatttatagtactacgacctaactaaacggccggtacccgttacggttaacggggtttacctaaacttccggtcctttccgttacccgtacgggtaccttaccgtaaacggttccgttacggaacccgtaaccgtacccgggtccccttacccgtacgaaacctaaacttccgttcgtcggggacccttcccggaaggtacgtagggaacggacgaacggtctaagtacttacgaccgtagtccgtagtcctagtattacgtacggacgttacggttaccgttacttctttacgttacgttacgttaccggttaacggtaaaccggttacggggtaaacccgttaaaccgggttacccgttaaccccggttaaccggtaaccggtacccgtaaccggaacccccgttaaaccgggtaaacccccaaacccctaaccggtttccgtaccctttaacccccgg

SEQ ID NO: 417772 - DNA, 543 bp, Homo sapiens
  misc_feature: GZ8MTXP02IMFJP.19.78.H01.1.454.CMB.2.raw
  modified_base (401)..(401): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttaggaaattctaacttgtctctgtaccacatcaccaaataaacgccccaaatcatcattatgatgccataagcgccctcagggttctaatcgcttctcctggctcctaagtctggaccacgaccggccctcctgaccaatctctgggctccaggctgagacgnggctgattacactgctgctcatatgcaggtctatctcttatgtcgttacgtaacgtacggtaccgtaaacgggtactacccgtaccgtacggttacgaacgacccgaaccggaccgaaccccaaaccgtacgtcttaacccg

SEQ ID NO: 417773 - DNA, 559 bp, Homo sapiens
  misc_feature: GZ8MTXP02F48IN.19.78.H01.1.454.CMB.2.raw
  modified_base (266)..(266): a, c, t, g, unknown or other
  modified_base (451)..(451): a, c, t, g, unknown or other
  modified_base (467)..(467): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacgagggtcctgggcccagtctgccctgactcagtctgcctccgtgtctggtctcctggacagtcggtcaccatctcctgcactggaaccagcagtgatgttagaaattctaacttgtctctgtaccaanatcaccaaataaacgaccccaaactcatctatttatgatgaccactaagccggccctcgtagggtttctaatcgtcttctctggctacaagtctggcacaccggcctccctgactaatctcgtcgggcctaccgaggcgtaggacgggtacgaggccttagtaacttactacttgctgactcatntgctaggtctattctnttatgtcttacggacgtggaccgtaaggtcctaccgtcgtagtaccgaacgaccccgaaacggaccccaaaccccgtctacgtacttacccg

SEQ ID NO: 417774 - DNA, 527 bp, Homo sapiens
  misc_feature: GZ8MTXP02HV9HA.19.78.H01.1.454.CMB.2.raw
  modified_base (264)..(264): a, c, t, g, unknown or other
  modified_base (361)..(361): a, c, t, g, unknown or other
  modified_base (376)..(376): a, c, t, g, unknown or other
  modified_base (379)..(379): a, c, t, g, unknown or other
  modified_base (383)..(383): a, c, t, g, unknown or other
  modified_base (385)..(385): a, c, t, g, unknown or other
  modified_base (387)..(388): a, c, t, g, unknown or other
  modified_base (394)..(394): a, c, t, g, unknown or other
  modified_base (396)..(396): a, c, t, g, unknown or other
  modified_base (404)..(404): a, c, t, g, unknown or other
  modified_base (406)..(406): a, c, t, g, unknown or other
  modified_base (409)..(409): a, c, t, g, unknown or other
  modified_base (412)..(412): a, c, t, g, unknown or other
  modified_base (416)..(416): a, c, t, g, unknown or other
  modified_base (419)..(419): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtagaattctaacttgtctctgacaacanacaccaaataaacgaccccaaactcatcatttatgatgaccactaacgcggtccctcgtaggggtttctaaatcgcttctcctgctcagtctgcacncgcctcctgacatcncgngtcngngnngagagngntgatacangngtnctnagtncgngtagtacgtctcttatagtcgtcgtacggtaacggtcggtaacacgtaccgtccgttacgtacgaccgtaacgacccgaaccggaccccaccgtacgccttactaccg

SEQ ID NO: 417775 - DNA, 845 bp, Homo sapiens
  misc_feature: GZ8MTXP02I5EFM.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttaggaaattctaacttgtctcctggtaccacataccacccaaataacgacccccaaactcactactatttatgatcgaccaactaacgccggtacccctcgtacggggttttacctaaatccggtcttttccgtcccgttcgggcccttacccgtaaacggttccgttacgggaccctaaccgtaacccgggtccccttacccccgtacggtaaacctaaacgtttcccgttcccggttacgggggtccctttaccccggaacggggcccttaggggaaacggggtaaccggaaccgggtaccgttacgggttaaactttaacccgttaaccgttacgggtccccttaaggtccctttacccgaactttaagtttcggacccgttaaacgggggtttccgtttaaacgtttccccgtttatttaaacgtttcggttacccggtttttaaaccggggaaaaccggttccgggggtaaaaccccgtaaaacggggttccccgttaaaaccccggttcccggttaacgggttaccgtaaaccggtaccccccgtaaaacccggggaccccctaaaaaccccccgtaccggtttccgtaacccgtttaacccccg

SEQ ID NO: 417776 - DNA, 643 bp, Homo sapiens
  misc_feature: GZ8MTXP02IV2M8.19.78.H01.1.454.CMB.2.raw
  modified_base (223)..(223): a, c, t, g, unknown or other
  modified_base (272)..(272): a, c, t, g, unknown or other
  modified_base (291)..(291): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcacatctctgcactggaaccngcagtgatgttagaattctacttgtctctgaccacatcaccaaataacnccccaaatcatctatttangatcgaccacgtaacgcccggtacccttcgtagggtttacctaatccgtcttcctcgtcgcctacaacgtcgtcgaccacgcccggtccctcccgtagacctaatccgttcgtcggggtcctccgaggtcgtagggaacgggtacgacggtcttaggtaaactttacgtacgtcggtacttcggacttactaattacgtcgtacggttaggttaccttattccctttgttaatcggttacgttacggaacggttacggggtaaacctaacggtaccttacccggtaccgttacggtaccaaccggtaaccccgaaccggtaccccaacccgtacgttacgtacccttacccg

SEQ ID NO: 417777 - DNA, 651 bp, Homo sapiens
  misc_feature: GZ8MTXP02IEGCF.19.78.H01.1.454.CMB.2.raw
  modified_base (645)..(645): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaaccttgtctctgtaccacatcaaccaaataacacccccaaatcatctaattatgatcgaccaacgtaacgccggtacccgtcgtaacggggtttacctaaacttccggtctttctcccgtggacctaccgtaaacgttcgtacggaccacgtacccggtcccttaccctacgaactactacgtccgtcggggtaccttccgaaggtccgtagggaacggtacgaaggtcttaggtaacttacgtaactgggtcctcggtacctacgtaaagtgtaccggtaccgtacgggttacgtttaacttccttagtttacgtcgtacgttacggtaacgtggaacccgtaaggtaccgtaccgtccgtaggaccaacgacccgaaaccgcccaaacccgtcgtccncttacc

SEQ ID NO: 417778 - DNA, 488 bp, Homo sapiens
  misc_feature: GZ8MTXP02GDWA4.19.78.H01.1.454.CMB.2.raw
  modified_base (367)..(367): a, c, t, g, unknown or other
tcagtactctcgtgcacgaccggtgctcgatttagtgtgagtagtttgggtttggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaactgtctctggtacacatcaccaaataaagcccccaaactcatcatttatgatgccactaagcggccctcaggggtttctaatcgcttctcctgctcaagtctgcacacgctcctgacatcnctggctccagctgagacgaggctgattactactgctgctcatactgcaggtctatctcttatgtcttcggaaatggacctaaggtcacgtcaggtcaagccaagcccaaccactcgtctac

SEQ ID NO: 417779 - DNA, 720 bp, Homo sapiens
  misc_feature: GZ8MTXP02I0TWA.19.78.H01.1.454.CMB.2.raw
  modified_base (196)..(196): a, c, t, g, unknown or other
  modified_base (260)..(260): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacngtcggtcaccatctcctgcactggaaccagcagtgatgttgaaattctaactgtctctgtacanatcaaccaaataacgccccaaatcatctattatgatcgaccactaacgccgtaccctcgtaggggtttacaatccgtactttcctccgtcggtcctaccgtaagttccgtacggaccacggtcccggtcccttaccccgtagtaacctaaagttccgtacgttcggggcctcccggaagggccttagggaacggtacgacgggtcttagtaacgttaactcgtcggtaccgttcacgttactaacgttagtacggtaaccgttagggttaccgtttacttacccgtttacgtttaacgtaccggtttaccggttaaaacggggttaaaacggttaccggggtaaacccgttaaacgggttccctaaacccgggttaccgtaccggttaacccgaaccggaacccccggaaacgggtaacccccctaaaacccgttacgttccggtaaccctttaacccgg

SEQ ID NO: 417780 - DNA, 789 bp, Homo sapiens
  misc_feature: GZ8MTXP02JR0W4.19.78.H01.1.454.CMB.2.raw
  modified_base (266)..(266): a, c, t, g, unknown or other
  modified_base (398)..(398): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactaggaaccagcagtgatgtagaattctaaccttgtctctgtacacactacaaccaaataacaccccaaactcatctattatnatcgaccactaacgccgtcccgtgtacggttactatcgtacttctcgtcggcctaccacgtcgtacggaccaaccgaccggtccctaccgtacgaacctactccgtcgtcggtcacgaggcaggacggacgnggacttagtacttacgtacgtcgtacgtctactcgtaaattcggtacgacggttaccggttaactttacttcccgtttagtttaacgtttccggttaacccggttttaaccggggaaacccggtttacgggggaaaacccccttaacgggggttccccctttaaacccccgggttaaccggtttaccggggtaaacccaaccccggttaaaccccgaaaaccccgggtaccccccgtaaaaaccctcccggtaccgttaaacccttacccccggtttccgtaaccccccgttttaaccccccaccccggttaccccgtaaacggtaacccggtaaacgtacccggtttacggaaccggggtaccggggccggggttacggtaacccggggg

SEQ ID NO: 417781 - DNA, 642 bp, Homo sapiens
  misc_feature: GZ8MTXP02IV5EZ.19.78.H01.1.454.CMB.2.raw
  modified_base (214)..(214): a, c, t, g, unknown or other
  modified_base (224)..(224): a, c, t, g, unknown or other
  modified_base (233)..(233): a, c, t, g, unknown or other
  modified_base (237)..(237): a, c, t, g, unknown or other
  modified_base (253)..(254): a, c, t, g, unknown or other
  modified_base (283)..(283): a, c, t, g, unknown or other
  modified_base (288)..(288): a, c, t, g, unknown or other
  modified_base (298)..(298): a, c, t, g, unknown or other
  modified_base (315)..(315): a, c, t, g, unknown or other
tcagtactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcgtcaccatctcctgcactggaaccagcagtgatgtagaattctacttntctctgacanatcaacaanaacncccaatcatctattannatcacacacgcgcctcgtaggttctatcnctctncgcacagtcngacacgaccgtctcctnactactcctcgcgctcgaggctagacggacgacggtactacgtacttacgtcgtagtcgtcgtctacgaatacgtacgtacgtacggttacgttactttaccttaacgtttcgttacggttacgtttaacccgggaaccgttacgggaaaccgtaccgggttacccgtaaccggtaccggttacgaccgtaaaccgaccccgtaaacccggacccctaaacccgtaactccgtaaaccgttcccgttacccgtcccggttaccccctaccctacccgtaaccgaacgtacgtacgtaaccggacgtacgggaccggttacgaaccgg

SEQ ID NO: 417782 - DNA, 669 bp, Homo sapiens
  misc_feature: GZ8MTXP02JSXWC.19.78.H01.1.454.CMB.2.raw
  modified_base (261)..(261): a, c, t, g, unknown or other
  modified_base (264)..(265): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcgtcaccatctcctgcactggaaccagcagtgatgttagaattctaacttgtctctgtaccaacatacaaccaaataacacccaatcatctattangannacatacgcgcctcgtaggttctatcgtcttctctgtctacagtctgaccaacgcgcctcctagactactcccgtcgtcggtcctaccgaggtcgtaggacgggacgacggtctagtaacgttactacgtgtcctacgtctacgtaatcgtaggtacgtacggttacgttaactttccgttacgtttaagtttcggttaccgtttaaccgggtaacggttaccgggtaaccctaaacgggttcccgtaacccgttaccgtaacgggttacccaaccggaccccgtaaaccggaccccctaacctaccgttcgtaccctaccgttacccgttcccgtaccccctaccccttacccgtaccgaacggtaaccggtacgtacggtcgacgggtccggtacgtaacggg

SEQ ID NO: 417783 - DNA, 708 bp, Homo sapiens
  misc_feature: GZ8MTXP02GHY39.19.78.H01.1.454.CMB.2.raw
  modified_base (521)..(521): a, c, t, g, unknown or other
  modified_base (536)..(536): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactcggaaccagcgtagtgtagttggtaagtaacttaccttacgtcgtcctcgtacgaacacactaccaaacctaaaacgtaaccccaacccctaaactactaatactttaaattagtagtaactccgaacctaaacgtaacggcccgtaccctaggggttacggtttaactacgtctcttctcgtccgtccaacgtaacgtcgtacgaacctaccggacccgtccccttacgactaacctacgtcgtacgggtcgccctaacggacgtcgtaggggaacgtagacggttctagttaacttaccgngtctcgtactactanacgttaggcgtaacggtacgttacttacgttcttacgttacgttcgttaaccggtaacgggtaaccgggtaaccggtaaaccgttaacggtcccgtaccggtaaccgaacgtacccgaaaccccggaacccgtacccgaaccccctaaccgtacgtaccctaccttaacccg

SEQ ID NO: 417784 - DNA, 710 bp, Homo sapiens
  misc_feature: GZ8MTXP02FJCBQ.19.78.H01.1.454.CMB.2.raw
  modified_base (227)..(227): a, c, t, g, unknown or other
  modified_base (233)..(233): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtnatgtgaatctactgtctctgtacacatcaccaaataacgaccccaaactcatctatttatgatcgaccactaacggccggcccctacgtacggggtttactaaagtccgtcttctcctcggtcctcctaaacgtctacgggacctacgtacccgggcccttaccccgtacgtaacctaaacttcccttaccgttacgggggtcccttacccggaacgggtcccgttaggaacggggtaacggaacgggtcttacgggtaactttaaccgtaacttcggaccttgtctactattacgtgacccgtagggttaccttattaccttcgtttaagtcgtttaccgtttacgggtaaaacgttacgggggtaacccgtaaacgggttacccgtaaacccggttccgtaacggggttaccaaaccggtaccccaaaaccggggaccccctaaaaccccgtaccgttaccgttccctaaacccg

SEQ ID NO: 417785 - DNA, 558 bp, Homo sapiens
  misc_feature: GZ8MTXP02GPVR0.19.78.H01.1.454.CMB.2.raw
  modified_base (261)..(261): a, c, t, g, unknown or other
  modified_base (294)..(294): a, c, t, g, unknown or other
  modified_base (358)..(358): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcgtcaccatctcctgcatggaaccagcagtgatgttagaaattctacttgtctctggtaccaanatcaccaaataaacgccccaaactcatcattangatgccatagcgccctcagggtttctaatcgcttctcctgcctcaagtctgcacacggcctccngacaatctactgctccgagctggagacgagggctaggaattacgtactcggctgacttacattaagtgacgtaggtacgttaatcgttccttaagtttcgtaccgtttccggaaaacgttcgggtaaacctagggtacctaccgttaccgtacggttacaacgtccccgaaacggacccaacccgtactcgtactacccg

SEQ ID NO: 417786 - DNA, 694 bp, Homo sapiens
  misc_feature: GZ8MTXP02F0AW4.19.78.H01.1.454.CMB.2.raw
  modified_base (207)..(207): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccntctcctgcactggaaccagcagtgattgttagaattctaacttgtctctgacacatcaaccaaataacgaccccaaactcatctattatgactcaccaactaacggccggtcccgttacgtacggggtttactaaacgtcgtcctttctcccgtcggtcctaccgtaagttccgtacggaccaccgacccggccctccctacgaacctaacttccgtcgtcggggtccttacccggacggtcctaggaacgggacgtacggcgttacgtacttacctacgtgtctcgtctactaattacgtcgtacgtacgggttaccttattcctttacttaacgttcggttaccggttaacgggttaacgtacgggtaaacccgttaaacggttacccaacccggtttaccgaacggttaccgaacccggtaacccccgttaaaaccgggaccccctaaaaccccgtttccgttacggttacccgtttaaccccg

SEQ ID NO: 417787 - DNA, 670 bp, Homo sapiens
  misc_feature: GZ8MTXP02JS2GH.19.78.H01.1.454.CMB.2.raw
  modified_base (226)..(226): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacaggtcggtcaccatctcctgcactggaaccngcagtgatgttagtaaattctaacctgtctctgtaccaacatacaaccaaataaccgaccccaaactcatctaatttactgactcgacctaactaacggccgtccctaggtaacgggtttctaacgttccgctttcgtccgtacggcctaccgtaacgtcgtacggacctaaccgccggtccctcccgtagaacctaacgtccgtacgtcggtcctaccgacgtcgtaggaacggaccgtaggtcctagtaacttcgtaactggaccttgacctagtagttaccgtagtacgtaccggttacgttacttcttccgtttaagtcggttaaccgtttaccggggaaaagtacggggtaaccctaaagggttccctaaacccggtcggtacgtaccgaaccgaccccgaaacggacccccaaacccggtcttaccgaccttaccccg

SEQ ID NO: 417788 - DNA, 741 bp, Homo sapiens
  misc_feature: GZ8MTXP02JFHUX.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagctagtgatgttaggaaacttctaacttgtctctgtacaacactacaaccaaataaacgaccccaaactcactacattatagtatacgaccaacgtaacgccggtacccgtacgtacggggtttactaaacgtccggtcctttccgtcccgtcgggtacctaccgtaaacgttccgtacggaccgaaccgtacccggtacccttacccttacggaaccttaaacgttccgttaccggtacccggggtccttacccggaacgggtccgtaggggaacgggtaaccggaacgggcttaaacggtaactttaacccggtaacgtttcggaaccgttacggtcccgttaaaagtaacgttacggttacgtaaccggttacgggtttacgtttactttacgttactttacggttacgttacggttaaccggtaacggtacggtaaaccgtaacggtaccgtaccgtacgtacgtacgaaccggaccgaaaccgtaccctaaccgtaccgtacgtacctcg

SEQ ID NO: 417789 - DNA, 676 bp, Homo sapiens
  misc_feature: GZ8MTXP02FXW2B.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatcgttaggaaattctaactgtctctgtacacatcaaccaaataacgaccccaaatcatctattactgatgaccactaagccggccctgtaggggtttactatcgcttctcctacggctacaagtctggtacaccgtccggccctacctagacctaatcctcgtcgggcctcgacggctaggaacggacggtaggtccttaggtacttaaacccgttacgtcgtcgtacgtactacgtacttacgtacgtaccgttacggttacgttacgtttcgttaccgtttagtttaccggttaccggtttaaccggtaacgggtaaccgggtaaacccggtaaacccggttccgtaaccccggtttaccggtaccggtaacccgaaccccggtaaccccggtaaacccgtacccccgtaaacccgtaccgttaccgtacccgtacccg

SEQ ID NO: 417790 - DNA, 601 bp, Homo sapiens
  misc_feature: GZ8MTXP02G2IM7.19.78.H01.1.454.CMB.2.raw
  modified_base (196)..(196): a, c, t, g, unknown or other
  modified_base (223)..(223): a, c, t, g, unknown or other
  modified_base (229)..(229): a, c, t, g, unknown or other
  modified_base (269)..(269): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccatctcctgcactgaaccngcagtnatgtgaattctactgtctctgtacacatcaccaaataacnccccaaactcatctattatgatgaccactaacgccgtaccctcgtaggggtttactaagtcgtcttctcccgtggtcctacaagtcctcggacaccgaccggtccctccctagacctaactcctcgtcgggtcctaccgaggctaggacggacgacggtctagtaacttaccacttcggctgtctactatacgtgcgtaggttccttattccttatttacgtgttaccgtttacggaaaccggtcggtaaccgtaaacggtccgtaccggttaccgtacggttaccgaacgaccccgaacggtaccccctaacccgactccgtacctacccg

SEQ ID NO: 417791 - DNA, 585 bp, Homo sapiens
  misc_feature: GZ8MTXP02G6269.19.78.H01.1.454.CMB.2.raw
  modified_base (296)..(296): a, c, t, g, unknown or other
  modified_base (332)..(332): a, c, t, g, unknown or other
  modified_base (431)..(431): a, c, t, g, unknown or other
  modified_base (438)..(438): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcaccatctcctgcactggaaccagcagtgatgtagaaatctaacttgtctctgaccaacatacaaccaaataacaccccaaactcatcattangatgaccactaagccgccctgtagggtttcaagtcncttctcgtgctcaagtctaggcacgccgcctcctagaactactctcgtcggctccgaggctaggacgacgacgcgtagtacttacgtacgtgctcgctnaagttancgacgtacggttctaacttccttattagtcgtttaccgttacggtaaacggtcggggaaacctaacgggtccctaccggttacgttacggacccaaccgaacccgaaaccggaccccctaaaacccggtctacggtaccttaacccg

SEQ ID NO: 417792 - DNA, 715 bp, Homo sapiens
  misc_feature: GZ8MTXP02GFYCW.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactcggaaccagcagtgattgttagtaaattcctaacttgtctcctagtaccaacactacaacccaaacaaccaccccaaatcaatactaattatagactacgacctaacgtacgccggtacctacggtagggtttactaactcgtcttctccgtcggtcctacaagttcacggtacacgtaccgcctcctagactaacgtctcgtcgtactaccgaggtctaggaacggtacgcggtactacgtacttaaacgttcgtacgtcgtcgtactaccgttaattacgtacgtacccgttaagggttacttccgtttaacttgtttaacgtttacggtttaccggtttaaccgggtaaaacgggtttacccggggaaaacccgttaaacgggttcccgttaaccccggttaaaccgggttaccggtaccaaccccggtaaaccccggaaaacccggtaacccccgacccccgttaaagtttccccgtacccgtttaaacccg

SEQ ID NO: 417793 - DNA, 624 bp, Homo sapiens
  misc_feature: GZ8MTXP02FZ4GP.19.78.H01.1.454.CMB.2.raw
  modified_base (205)..(205): a, c, t, g, unknown or other
  modified_base (225)..(225): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcgtcacntctctgcactgacagcagtnatgtagaattctactgtctctgtacacatacaaccaaataacaccccaaatcatctattatagatcgacctaacgtaacggccggtacccgtacggtaacgggtttactaacgtcgtacttctccgtcgacctacgaacgttcgtacgaccaccgaccgtcctacctacgaacctatccgtctcgggcctccgagtcgtaggacgacgaggtctagttacttactacgtagtctcgtcctagtaagttagtacgtacgtacgggttacttctttcgttagtttattcggttacggttaacggacggtaccggaaacgtacgttaccgtaccgttaccgtacgtaccgaaccggacccgaaacggtaccccctaaccctacgttacgtacctttaccccg

SEQ ID NO: 417794 - DNA, 689 bp, Homo sapiens
  misc_feature: GZ8MTXP02F0Z8P.19.78.H01.1.454.CMB.2.raw
  modified_base (260)..(260): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctctgcactggaaccagcagtgatgtagaattctaactgtctctgtacanatcaccaaataacaccccaaactcatctattatgatcgaccaacgtaacgccggtccctagtacggggttttactaaacgtccgtaccttcgtcccgtcggtacctaccgtaacgttccgtacgggaacccaaccgacccgggtccccttacccgtacgtaacctaacttccgtcgttacggggccttacccggaggtaccgtaggaagggacgacggtcttaggtaacttaaccgtcgttcggtctacgactactagttaacgtcggtacccgtagggttacttaattccgtttacttaacgttcggtttaccggttaaccggtaacggtaccgggtaaacctaaacgggttaccctaacccggttaccgtacggtaccgaaccgtaacccggaaccgaccccaaccccgtacgtaccgtaactcccg

SEQ ID NO: 417795 - DNA, 711 bp, Homo sapiens
  misc_feature: GZ8MTXP02FRFPX.19.78.H01.1.454.CMB.2.raw
  modified_base (229)..(229): a, c, t, g, unknown or other
tcagtactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttagaattctaacttgtctctgtacaanactacaaccaaataacgccccaaatcatctatttatgatcgaccacgtaacgccggtcctacgtacgggttactaacgtcgtcttctcgtcggtcctaccgaagttccgtcggaccaaccgtaccggtcccctccccagaacctaactccccgttcgtcggcctccggtaggccgttgggacgggcgaggcttagtaacttactacgtcgtctcgtactactaagttacgtcggtacgtacgggttacgttaacttcgttaaacgttcgttaccggtttccgttaaccgggaaaccggtaccgggtaaacccgtaaacgggtcccgtaacccgttacgttacggaccaaccggaacccgaaccggtaacccctaaccccgtactccgtaacctccgttaacccttcccgtaaccccctaccccttaccgtaccgtaacggtaacgtaacggtaaccgcgggtaccggccgggtacgtaacgg

SEQ ID NO: 417796 - DNA, 533 bp, Homo sapiens
  misc_feature: GZ8MTXP02F6OFU.19.78.H01.1.454.CMB.2.raw
  modified_base (404)..(404): a, c, t, g, unknown or other
  modified_base (412)..(412): a, c, t, g, unknown or other
  modified_base (436)..(436): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgtggaattctaacttgtctctgtacacatcaccaaataacgaccccaaactcatctatttatgatgccactaagcggccctcgaggggtttctaatcgcttctcctgctcaagtctcggcacgacgcctccagacaactctctggcctcgagctgaggcgagctgatactntgctgctnatacgtgccgtaggtcgttatctntttagtgtcgttacggaacgtgggtacccaaaggttccacccgttacacggtccaacgaccccgaacggtacccaacccctacgtcggtactacccg

SEQ ID NO: 417797 - DNA, 604 bp, Homo sapiens
  misc_feature: GZ8MTXP02FL8K7.19.78.H01.1.454.CMB.2.raw
  modified_base (227)..(227): a, c, t, g, unknown or other
  modified_base (301)..(301): a, c, t, g, unknown or other
  modified_base (369)..(369): a, c, t, g, unknown or other
  modified_base (379)..(379): a, c, t, g, unknown or other
  modified_base (399)..(399): a, c, t, g, unknown or other
  modified_base (417)..(417): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacagtcggtcaccatctcctgcactggaaccngcagtgatgtggaaattctaacttgtctctgtaccaacatcaaccaaataaacgccccaaactcatctatttangatcgaccactaacgccggccctcgtaggggttctaaagtcgtcttctcctggctacaagtctgcacncggccttccngacaatccgtctacgggtcncgtacgcgtggagaacgngctagtattactactcggctacgctacagttacgtgtccgtaagggttctaacttcgttactttagtcggttactttaacgggaacggttacggaaccggtaaacgttaccgtaccccggttactaacggggttaccaacgggtaaccccaacgggtaacccctaacccgacctaccgtactacccg

SEQ ID NO: 417798 - DNA, 582 bp, Homo sapiens
  misc_feature: GZ8MTXP02HS0G8.19.78.H01.1.454.CMB.2.raw
  modified_base (226)..(226): a, c, t, g, unknown or other
  modified_base (300)..(300): a, c, t, g, unknown or other
  modified_base (355)..(355): a, c, t, g, unknown or other
  modified_base (419)..(419): a, c, t, g, unknown or other
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccngcagtgatgttggaaattctaaccttgtctctgtaccaacatcaccaaataaagcccccaaactcatcatttangatgccataagcgccctcagggtttcaatcgcttctctgctccaagtctggcacncggcctcctgacaatctctgggctccgaggctgaggacgaggctgattactactgctgaccttntatagtcgcgtaggtactatcttacttagtcgttacgttacggtaaacgttacggggaaaccctaacgggttaccctaacccggttaccgttacgggtacccaaccggtaacccccgaaaaccgggtacccccaaaaccccgtccgttacggttacctacccg

SEQ ID NO: 417799 - DNA, 540 bp, Homo sapiens
  misc_feature: GZ8MTXP02FORST.19.78.H01.1.454.CMB.2.raw
  modified_base (295)..(295): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctcgtgtctgggtctcctggacagtcggtcaccatctcctgcactggaaccagcagtgatgttagaattctaactgtctctgtacacatcaccaaataaacgaccccaaactcatacatttangatcgacactagcggccctacgtagggtttctaatcgtcttctcctggcctacaatctgacaccgacgcctcctagactaatcctacgtggtcctcgacgacgtgaaggacgagcgtagtacttactatcgctgtcactactatcgctacggtctatcttcttatcgtcgttacgacgtaggacctacggtctacccgtctaacggtcaacgacccaacggacccaacccgactcgacttacccg

SEQ ID NO: 417800 - DNA, 724 bp, Homo sapiens
  misc_feature: GZ8MTXP02I4O7P.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatcctctgcactcggaaccagctagtgtatgttaggaaattctaaccttgtctcctggtaccaactataccaacccaaaataacgacccccaaatccaatacctaatttactgactcgacccacgtaacgccggtacccctagtaggggtttcctaagtcctcgttcctacgtcgtacctccgtaagtctacggacacgtacccgggcctacccctagtaacctaacgttcctcgggtacggtaccctacccgggtaacggtccgttagggaaaccggtaccgggtacggtacggttacgtaaatttccccgttaaaccgtggtccgttaacgtcccgttaactaccgtagttacggaccgtacgggtttacttaccgttacttcgtttaacgttcgtaccgttacggggtaacgtacggggtacctaaacggtccgtacccggttcgtaaccggggttaccaaccgggttaaccccaaacgggacccctaacccgtaccgtacgtaaccctccccg

SEQ ID NO: 417801 - DNA, 573 bp, Homo sapiens
  misc_feature: GZ8MTXP02HCQ9O.19.78.H01.1.454.CMB.2.raw
  modified_base (268)..(268): a, c, t, g, unknown or other
  modified_base (415)..(415): a, c, t, g, unknown or other
  modified_base (461)..(461): a, c, t, g, unknown or other
  modified_base (465)..(465): a, c, t, g, unknown or other
  modified_base (469)..(469): a, c, t, g, unknown or other
  modified_base (473)..(473): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaacttgtctcctaggtaccaanatacaacccaaaataaacgacccccaaactcaatacatttatgatgaccaactaaagccggtaccctacgtaggggttctaaatcgtcttctcctggacctacctaagtctaggacaacgtccgcctacccctagaacaaactctcncgggtctacccgaggctaggaaggagaggtctagtaattacaagtnctcnctanatanagacgtacgtatactcttatatagtcgtacgtacgacggacgaacgtacgtaccgtacgtacgacgaacgaccgaaccgaccaacccacctacgtactac

SEQ ID NO: 417802 - DNA, 600 bp, Homo sapiens
  misc_feature: GZ8MTXP02JROB7.19.78.H01.1.454.CMB.2.raw
  modified_base (230)..(230): a, c, t, g, unknown or other
  modified_base (301)..(301): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctccgtggacaggtcggtcaccatcctcctgcactggaaccngcagtgatgttagaattctaacttgtctctgtacacatcaaccaaataacgaccccaaactcatctattangtatcgacactaacgcgccctcgtagggtttactaatcgtcttctccgtgctcaagtctacggacaccgtaccggtcctcccgtacgtaactaactccttcgtcgggtcctacccggaggccgtaggacgggacgacggtactagtacttactactgtctagcctataattcgtacgacgtacggtctaactcttacgtttatacgtcttacgggaacgtacgggaaaccgtacggtaccgtaaccgtccgtacgtacaacgacccgaaacggacccaacccgtacgtacgtactcccg

SEQ ID NO: 417803 - DNA, 709 bp, Homo sapiens
  misc_feature: GZ8MTXP02HH2TB.19.78.H01.1.454.CMB.2.raw
  modified_base (228)..(228): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgccactggaaccngcagtgatgttaggaaattctaaccttgtctctgtacaacatacacccaaataacgaccccaaactcatctatttatgaatgaccactaaagccggcccttacgtacgggtttactaaatcgtctttctccctcggtcctaccctaaagttccgtcggtaaccaccgacccgggcccttaccccttacgaaccaaacttccttcgcggggtcctacccgaagtccgtaggaacggggaccggaggggtaccttaggtaactttaaccgtaacttcggtcccttaggtcctttaaccgaattaaggtcgtaaccgtaaaggggtttccgttaatttacccttttacgtttacgttcggttaccggtttaaccggtaacggttaccggggaaaccctaaacgggttaccgtacccggttaccgtacgtaccgaaccgaaccccgaaaccgacccccaaaccctaccgttaccgtacctacccg

SEQ ID NO: 417804 - DNA, 760 bp, Homo sapiens
  misc_feature: GZ8MTXP02G1N72.19.78.H01.1.454.CMB.2.raw
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctccgtggacagtcgtcacatctcctgcactggaaccagcagtgatgttagaaattctaacttgtctctgtaccaacactacaaccaaaataacgacccccaaatcactacatttatgtatacgacctaactaacggacccggtcccgttacgtaacggggtttactaaacgtccgtcctttactccgtcggtaccttaccgtaaacgttccgttacgggaaccaccggtaaccggtacccttacccgttacgaacctaaacgttccgttaccgtacgggggtccctacccggtaaacggccggttacggaaccggggtaacggacggtaccgttaacggtaaactttaacccgtaaccgttaggccctttaaacggccttaaccggtaattaacggttcgacccggttaaggggtttaactctttacccgtttatttaacgtcggttacccgtttaaggaaccggttacggggaaacccgtacgggttaccgacccggttaaccgttacggtaccgtaaccgaacccgtaaacggacccccgtaaaacctccggttaacgtcccttaaccccgg

SEQ ID NO: 417805 - DNA, 542 bp, Homo sapiens
  misc_feature: GZ8MTXP02FH889.19.78.H01.1.454.CMB.2.raw
  modified_base (248)..(248): a, c, t, g, unknown or other
  modified_base (436)..(436): a, c, t, g, unknown or other
  modified_base (452)..(452): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaattctactntctctgacacatcaccaaataacgaccccaaactcatctattatgatgccaactaacgccgccctcgaggggtttctaatcgtcttctcctgtacctcaagttctacggacaccgaccgccctcctagacaatctacgtcgggctccgagctggaggacgaggctagtattactactgctgctacatntagctagtcgtatctnttatgtacgttacggacgtcggaacacgtcgtaccgtacgtacgtaccgaacgacccgtaacgaccccgaaccctacgtactactacccg

SEQ ID NO: 417806 - DNA, 647 bp, Homo sapiens
  misc_feature: GZ8MTXP02HRPSN.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttaggaaattctaaccttgtctcctggtacaacatcacccaaataaacgccccaaactcatcactttatgatgccactaacgcgccctcgaggggttctactaatcgtcttccctacgtcggtcctaccgtaagttccgtgggaccaaaccgtaaccgggtcccctcccccgttaacgaccctaaattccctcgttccgggcccgttccgaacgggcgttaggaacgggacggaacggtcgtaggtactttacctacgtcgtacgtgtacctcgaattgttcgacgtagggtacttactcttctttagttcgttacgttacggtaacggtcggtaaccgtaacggtccgtacccgtcgttacggtaaccgtaccgaaccgaccgaaccccgaccctacgtacgttaacccg

SEQ ID NO: 417807 - DNA, 613 bp, Homo sapiens
  misc_feature: GZ8MTXP02FFW1D.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgtagaaattctaactgtctctgtaccacatcacccaaataaacgaccccaaactcatctactttatgaatgccaactaacgccggtacccctcgtaggggttttactaaactcggtcctttctccctcgggcctaccaagtccgtcggacctaccacggccctacctcgaccaatccttcgtcgggaccttccgaaggcctaggacggacgagccttagtattacctactgactgacctcaatagtgcgtaaggtcgttaatcttaccttatcgttacgttacggaacgtacgggaacctacggtacctaaccggttcctacggttaccgaacgtaccccgaaacggaccccaaccccgtacttacggacccttacccg

SEQ ID NO: 417808 - DNA, 790 bp, Homo sapiens
  misc_feature: GZ8MTXP02H5QTL.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggccagtctgccctgactcagtctgcctccgtgtcgtggtctcctggacagtcggtcaccatctctgcacgtggaaccagcagtgtatggttagaattctaacttgtctccgtgtacaacactacaaccaaataaaccgaccccaaactcatactatttatgtatacgaccaacttaacggccggtaccctacgtaggggtttaccaaagttccgtacgtttcctccgtacggtaccttaccgtaacgttacgtacggaccaacccggtacggtacccccttacccgtacgaaaccgtaacgtttccgtaccgttcggggtacctacccggtaacgggtcgtacggggaacgggtaaacggtacggtcgttaacggtaaactttacccgtaatacgtcctacggtaccttaaccgattaacgtcggaaccgttagggttaactttcgttaccgtttaactttacgttacggtttaccccggtttaaacgggtaccgggttaaccggggtaaacccgttaaacggggtcccccgttaaaacccggtccggtttaaccgttacccggaaacccggtaacccccggtaaaaccgggtaccccccaaaacccgggtaccctttaccggttaaaaccctttacccccgg

SEQ ID NO: 417809 - DNA, 754 bp, Homo sapiens
  misc_feature: GZ8MTXP02HB403.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtcctccgtggacagtcggtcaccatcctcctgcactggaaccagcagtgattgttagaattctaaccttgtacctctgtaccaacatacaaccaaataacgacccccaaactctactactatttatgactcgacctaacgtaagccggtaccctacggtacgggtttacctaaacgtcgtcctttctcgtcggtacctacgtacgtcgtagacctaccgaccgtccctacccgtagacctaacgtccgttacgtcgggaccttaccgaacggtcgtaggaacgggtacggacggtacgtacggttaactttaccgtaacgttgtaccgttccggtactttactaacgttacggttacgtacccggttacggggtttaccgttaactttccgtttaacgtttacgtttaccgggtttaaccgtttaacccggggtaaacgggttaccgggttaaacccggttaaacgggttaccccgtaccggttaccgttaacggttacccgaaccggttaacccccgaaaccgggacccccttaaacccgcccgtttacggtacccttaacccccgg

SEQ ID NO: 417810 - DNA, 637 bp, Homo sapiens
  misc_feature: GZ8MTXP02HGO3Z.19.78.H01.1.454.CMB.2.raw
  modified_base (264)..(264): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttagaattctaacttgtctctgtaccanatcaccaaataacaccccaaatcatcatttatgatgacactaacgcgaccctcgtagggtttctaaatcgtcttctccgtcgtcctaccaaacgttcgtcggaccaccgacccgggtccctaccccgttagaacctaaacttccgttaaccgttcggggcctaccgtacggccgttaggaacgggtaacgtacggggccttaggtaacttaccgtaacttcgtcgttacgctcaatagtcgacgtaggtctacttcgttccttaagtcgttacgttacggtaacgtacgggtaaccgtaacggtaccgtaccgttacgtaccggtactaaccggaacccgaacggaccccaaacccaccgtcgtacctacccg

SEQ ID NO: 417811 - DNA, 698 bp, Homo sapiens
  misc_feature: GZ8MTXP02F39IY.19.78.H01.1.454.CMB.2.raw
  modified_base (262)..(262): a, c, t, g, unknown or other
  modified_base (298)..(298): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctcgcctccgtgtcgtggtctccgtggacagtcggtcaccatctcctgcactggaaccagcagtgatgttagaattctactgtctctgacanatacaaccaaataacgaccccaaatcatactattanagatcgaccaacgtacggccgtccctacggtagggtttacaacttcgtctttcgtccgtacgtcctaccgtaagtcctacggaccaacgtcccgtcctacccgtacgtaccaacgttcccgtcccgggtcctacccgacggttcgaagggacggtaacggacggtactacggttaactttacaaccgtggtacctcgtacctttacgacgtttagacggtacgttaacggttcgtttaaaccgttcgtttaactttaacggttccggttaccgtttaacgggtaacggtaccggggtaaaacctacgggttaaccgtacccgtttccggtaaacgccgtaaacccggaacccgaaacccggaccctaaaacccggtctaccggtacctacgtttcccccg

SEQ ID NO: 417812 - DNA, 670 bp, Homo sapiens
  misc_feature: GZ8MTXP02GN5UZ.19.78.H01.1.454.CMB.2.raw
  modified_base (207)..(207): a, c, t, g, unknown or other
  modified_base (225)..(225): a, c, t, g, unknown or other
  modified_base (260)..(260): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccntctcctgcactggaaccngcagtgatgtgaaattctaactgtctctgtacacntcaaccaaataacgaccccaaatcatcattatgatgaccatagcgtcctacgtagggtttactaaacgtcgctttcctccgtcgacctactaacgtctacggactaccgaccgggtcccttaccctacgaacctaaagttcccgttccgttaaacgggggccctttaccccggaaagggttacccgggtacgggtaacggggtaaccgggtaaccgggtacgttaacgttaaacgttaaccgttacgttacggtacgtacgtacgttacgtacgtacgtacgtacgtacggttacgttacgttacttacgttacgttacgttacgttaacggtacgtacggtaccgtaacgtaccgtaccgtaccgtacgtacgaaccgaccgaaccgaccaacccgactacgtactacg

SEQ ID NO: 417813 - DNA, 800 bp, Homo sapiens
  misc_feature: GZ8MTXP02HMIV7.19.78.H01.1.454.CMB.2.raw
  modified_base (323)..(323): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacagtcggtcaccatctcctgcacgtggaaccagcagtgatgttagtaaacttctaaccttgtctcctcggtaaccaacactaccaaccctaaaactaaccgacccccaaagtcaactactaatttaangtaactcgacctaacgtaacggcccggtacccgttacggtaacggggtttacctaaacgtccgttccgttacctaccgtacggtaccttaccgtaacgttaccgtacgggtaacctaaccgtacccggtacccttaaccccgtacggtaaacccttaaacgttccgttacccgtaccggggtacccttacccggtaaacggtcgttacggggaaacccgggtacggtacggtaccgttacggtaaactttaccgaacgttacggccttagtacctttacagttacgtacgtcgttacggggttactacgtttacgttacgttacgttacgttaccggtttaaccgggtaacggtaccgggtaaaacccgttacgggtaacccgttaaccggttaccgtttaacggaccccgtaaaccggtaaccccgaaaccgtaccccctaaaacccgttaacgtaccggtttaaccttaaccccg

SEQ ID NO: 417814 - DNA, 571 bp, Homo sapiens
  misc_feature: GZ8MTXP02GG5DE.19.78.H01.1.454.CMB.2.raw
  modified_base (269)..(269): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgatgtgaaattctaactgtctctgtacacatcaccaaanaacgccccaaatcatctattatgatgccactaacgcgccctacgtagggtttactaatcgtcttctctcgctcaagtctggcacgacgcctacctgactaatctacgcggctaccgaggactcggaaggacgaggtctagtaacttactacgtgtctgaccttacgaacttagtgaccgttagggtcctagttcttctttagtcgttacgtacggtaacgtgggaaccctaaggtcccaaccgttcgaacggtccgaacgaccccgaaacggtccccaaacccctcgtcgtaccctaacccg

SEQ ID NO: 417815 - DNA, 713 bp, Homo sapiens
  misc_feature: GZ8MTXP02HQI71.19.78.H01.1.454.CMB.2.raw
  modified_base (232)..(232): a, c, t, g, unknown or other
  modified_base (302)..(302): a, c, t, g, unknown or other
  modified_base (473)..(473): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctagggcccagtctgccctgactcagtctgcctccgtgtctgggtctcctggacagtcggtcaccatctcctgcactggaaccagcagtnatgttaggaaattctaacttgtctcctggaccaacatcacccaaataaacgaccccaaatcatcatttangatgaccaactaacgccggtccctacgacgggtttctaaatcgcttctcctggctaccaagtctacgcacaccggcctcctagaactaactctaccgcggggtcctacccgacgggacttagggaacggtacggaaggtccgtagtaaacgtttactaacgtcgtaccgtntaccgttacgtaagttaacgtggtaacccgtaacgggggttaacttaacgttcctttaacccgtttagttacggttaacccgtttacggggaaaaccgtttacgggggaaaacccgttaaaccgggttaccgttaaccccggttaaccggtttaacggtacccgtaaaccggtaacccccgaaaaaccgggtaccccccctaaaaccctaaccgtaccggtttaaaacccttacccccgg

SEQ ID NO: 417816 - DNA, 652 bp, Homo sapiens
  misc_feature: GZ8MTXP02GQYIB.19.78.H01.1.454.CMB.2.raw
  modified_base (266)..(266): a, c, t, g, unknown or other
  modified_base (291)..(291): a, c, t, g, unknown or other
tcagtactctcgtgcacgaccggtgctcgatttagtgtgagtagtttgggttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctctgcactggaaccagcagtgatgtagtaatctactgtctctgacacatacaccaaanaacgaccccaaactcatctattatnatcgaccaactaacgccgtaccctacggtacgggtttactaaacgttccgtactttctacccgtcggtcctaccgtagttcgtacgaccaccgtaccgtccctaccgtacgtacaactccgtcgtacgtcctccgacgtcgtaggaacgggtacggacgtacgttaggtaacttaccgtacgttcgctgtacctcgtaagtacgtcgtaccggtcgggttactactttcgttaccgtttagtaccgttccgtttaaacggtaaccggttgggtaaaccgtaacggtaccctaccggttaccgtacgtacgaaccgtaacccgtaacggtaccccaacccggtaactccgtaaccttacccg

SEQ ID NO: 417817 - DNA, 615 bp, Homo sapiens
  misc_feature: GZ8MTXP02FIV9A.19.78.H01.1.454.CMB.2.raw
  modified_base (190)..(190): a, c, t, g, unknown or other
  modified_base (225)..(225): a, c, t, g, unknown or other
  modified_base (263)..(263): a, c, t, g, unknown or other
  modified_base (299)..(299): a, c, t, g, unknown or other
  modified_base (500)..(500): a, c, t, g, unknown or other
  modified_base (560)..(560): a, c, t, g, unknown or other
  modified_base (603)..(603): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctggtctccnggacagtcggtcaccatctcctgcactaggaaccngcagtgatgtagaaattctaactgtctcctgtaccaanatacaccaaataacgaccccaaactcatctatttangatcgacacgacgtcggccctacgtaggggtttactaaatccggtcttactccgtcggacctacgtaacgtcgtcggactaccgaccggcccttaccctagaaacctacgtccgtcgtcgggaccttccgaacgggctaggaccggggtacgacgggtcttacggtaactttacgtacctgccttagcttcaatagttacncggttagtccgttatcttcttaagtcgtacgttacggaacttcggggaaactacggtccnccggtacctagggtcaaaccgcccgaaacgccccgttaacccncgtcctactacg

SEQ ID NO: 417818 - DNA, 588 bp, Homo sapiens
  misc_feature: GZ8MTXP02GBTVA.19.78.H01.1.454.CMB.2.raw
  modified_base (232)..(232): a, c, t, g, unknown or other
  modified_base (438)..(438): a, c, t, g, unknown or other
  modified_base (443)..(443): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtnatgtagaaattctaactgtctctgtacaacatcaaccaaataagaccccaaaatcatcatttatgatgaccactaacgcggtccctagacgggtttactaatcgcttctcctcggctacaagtctggacaccaccggcctccctagacaactcctagcgggtctacccgaggctaggaaggacgaggtactagtaatactacgttntctcnctatagtacgtacgtacgtacgtacgttattacttacttagtacgttacgttacggtacggtacggtacgtaaccgtaccgtaccgtaccgtacgtaccgtaaccgaaccgaaccgaacccaacccgtaccgtacctacctaccg

SEQ ID NO: 417819 - DNA, 853 bp, Homo sapiens
  misc_feature: GZ8MTXP02FNNWH.19.78.H01.1.454.CMB.2.raw
tcagtactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcggtcaccatctcctgcactggaaccagcagtgatgttagaaattctaactgtctctgtaccacatcaaccaaataacgaccccaaactcatctatttatgatcgccaacgtaacgccggaccccttacgtacggggttttactaaacttccggtcctttccgttacccttcggggtacccttaccgaaacgtttccgttacggggaccctaaaccgtacccggggccccctttaccccgtacgtaaacctaaaactttccgttaccgttacgggggccctttacccggaagggtcccgttaggggacggggacggtaacggggtcttacgggtaaactttacccgtaacgttcggtacccgttaggtccccgttaactaacgtttaaaggtttcggtaacccggttaaacggggttttcccggtttaaacgtttcccttttacgtttaaacgttttccggtttaaaccccggttttaccgggggttaaaaccgggtttaaccgggggtaaacccccttaaaacgggggttaccccttaaacccccgggtttacccggttaccgggttaacccgaaacccggtaacccccggtaaaaacccggggaccccctaaaacccccccctaagtttcccggtaaaccctttaacccccgg

SEQ ID NO: 417820 - DNA, 707 bp, Homo sapiens
  misc_feature: GZ8MTXP02G9WDD.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcgtcaccatctcctgcactggaaccagcagtgatgttgaaattctaacttgtctcctggtaccaacatcaaccaaataaacgcccccaaactcatcatttatgatgccactaagcgccctcgagggtttctaaatcgacttctacgtcggctaccaaagtctggactacgaccggtccctaccctagaacctaactcttccgtcggggcccttacccgaaggccgtaggaacggggaccgaaggcctagaactttaacctaacgtcggtacttcggacctttacaatttaagcgtccgtaaagggttccgtaaacttcttacctttaagtcggttaccgtttaccgggaaaaccgtttcgggggaaaaccctaaacgggggttaccctaaccccgggtttacccgttaaacggggttacccaaacccggggtaaccccccgtaaaaaccgggggtacccccctaaaaacccccccggactttaccgggttaaccccgttaacccccg

SEQ ID NO: 417821 - DNA, 620 bp, Homo sapiens
  misc_feature: GZ8MTXP02HXCOI.19.78.H01.1.454.CMB.2.raw
  modified_base (205)..(205): a, c, t, g, unknown or other
  modified_base (221)..(221): a, c, t, g, unknown or other
  modified_base (223)..(223): a, c, t, g, unknown or other
  modified_base (227)..(227): a, c, t, g, unknown or other
  modified_base (247)..(247): a, c, t, g, unknown or other
  modified_base (259)..(259): a, c, t, g, unknown or other
  modified_base (292)..(293): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgcctgactcagtctgcctccgtgtctggtctcctggacagtcgtcacntctcctgcatgaaccngnagtntagtgtacgtaactctactntctctacgacanacacaaccaaataaccaccaaatcatatattannatcactacgtacgccgtactaggttacgttacacgtctcttctccgtcgtactacgtacgtcgtacgactaccgccgtacctaccgtacgaactacgtcgtacgacgtacctacggacgtcgtaggtaacgacgtagtactaacgtacttacgtacgtcgtctacgtactagtagtacgtacgtacgtacgttacgttacgttacttacgttacgttacgttacggttacggtaacggtaccggtaaccgtaacgtaccgtaccgtaccgtacgtaccgtaaccgtacccgaaccgtacccgtaacccgtaccgtaccgtacctccg

SEQ ID NO: 417822 - DNA, 765 bp, Homo sapiens
  misc_feature: GZ8MTXP02GLPJ6.19.78.H01.1.454.CMB.2.raw
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtcgtgggtctcctggacagtcggtcaccattctcctgcactggaaccagcagtgagttgttagtaaacttctaacttgtctcgtaggtaaccaacactaccaaccaaactaaaccgacccccaaactcatactaatttatgtatacgaccacgtaacgccggtaccctacggtacggggtttactaaactccgtactttctcccgtacggtcctaccgaacgttccgtacggaaccaccgtacccggtcccttcccgtagtaacccaacgttccgtacggtccgtacctacggagacgtaggaacgacggtcgtacgtaacgttacttactacggtctacgttacgtaccttaagtaagttacgtaacgtccggttacggttaccgtttactttacctttaacgtttcggtttaccggtttacccggttaaacgggtaccggggttaaaccggtaaacccgggttaccgttaacccggttaaccggttaccggtttaaccgtaacccggtaaacccggaaacccccggtaacccgtaaaacccccgtaaacccgtaccgtttaaccgtaacccttttaccccgg

SEQ ID NO: 417823 - DNA, 662 bp, Homo sapiens
  misc_feature: GZ8MTXP02GKEVU.19.78.H01.1.454.CMB.2.raw
  modified_base (264)..(264): a, c, t, g, unknown or other
  modified_base (291)..(291): a, c, t, g, unknown or other
  modified_base (299)..(299): a, c, t, g, unknown or other
  modified_base (421)..(421): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctcctggacaggtcgtcaccatcctctgcacgtggaaccagcagtgatgtagaattctacttgtctctgtaccactancaaccaaataacgccccaaaatcactntactttanagactacgacctacgtacgcgtccgttacggtacggtttactactccgtcttcgtccgtcgtcctactacgtcgtacgactacgaccgtccctactacgactacgtcgtcgtacgctacggngacgtaggacggtacgacgtcgttacgtaacttacgtacgtcgtacgtacgtacttcaacgttacgtacgtacgttacggttacttacgtttacgttacgtttaacgtaccggttacgtaaccggtaacggttaaccgggtaaaccgttaaaccgggtaccgtacccggttacgtaaccggtaccgaaaccggtaacccgtaacccgtaccccaaacccgttcgttaccgtaccgtacccg

SEQ ID NO: 417824 - DNA, 727 bp, Homo sapiens
  misc_feature: GZ8MTXP02FUDTL.19.78.H01.1.454.CMB.2.raw
  modified_base (295)..(296): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacagtcgtcaccatctcctgcactggaaccagcagtgattgtagtaattctaacttgtctctgacacatacaaccaaataacaccccaaatcatctattannatgaccagtaacgccgaccctcgtagggtttactaactcgtcttctccgtcggtacctacctaaagttccgtacggaccaccgccggtccctaccgtagacctaaatccgttaccgtcgggtaccttcccgaagggccgttaggaacgggaacggtacgggtaccttaggtaaacttacgtacgtcgtctcgtacctataacgttagtacgtacgttaacgggttacttacgtttacctttacgtttaacgttcggttttaccccgttaacggggttaaccgtttaccgggggaaaacccttaaccggggttaacccccgttaacccgggttttaaaccggaaccggtttaacccgaaacccggtacccccggaaaaacccggacccccctaaacccccggtacgtttaccccgttacctttaacccccgg

SEQ ID NO: 417825 - DNA, 578 bp, Homo sapiens
  misc_feature: GZ8MTXP02JVK8W.19.78.H01.1.454.CMB.2.raw
  modified_base (263)..(263): a, c, t, g, unknown or other
  modified_base (306)..(306): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatcctcctgcactggaaccagcagtgatgttagaaattctaacttgtctctgtancaacatcaaccaaaataaccgacccccaaatcaatctatttangatgaccacgtaacggccgtccccgtcgtacggggtttctaagtcgtcttcctctcgtctacaagtctggccacaccggtcctccgagtactactcgttcgtacgggcctaccgtaggaccgtagggaacgacggacggtcgtagtacttactacgtgtctcgtctagtactagtgacgtagttcgttactcttacttgtacgttcgtacgtacgtacggaccacggtccacgttacgtagccgtacgaccgacgaccgaccctctactccg

SEQ ID NO: 417826 - DNA, 838 bp, Homo sapiens
  misc_feature: GZ8MTXP02JKJII.19.78.H01.1.454.CMB.2.raw
  modified_base (197)..(197): a, c, t, g, unknown or other
tcagtactctcgtgcacgaccggtgctcgatttagtgtgagtagtttgggtttgggggtcacaagaggcagcgctcctcgggacgtctccaccatggcctgggctctgctgctcctcactctcctcactcaggacacagggtcctgggcccagtctgccctgactcagtctgcctccgtgtctgggtctcctggacngtcggtcaccagtcctctgcactggaaccagctaagtgtacttggttaggtaaaacttctaaaccttggtacctccgtacggtaacccaaactactaccaaccctaaaataaaacccgtaccccctaaaaacttcaaacgtttacctaatttactacgtactacggtaccctaagttaaacggcccgggtaccctacggtaacggggtttactaaacgtccggtactttacctccgttacggccttaccgaacggttcgaccggactaacccggtccgggtaacccttccaggtaacctaaacgttctaaccggtccggggtacccttaccgacgggtaccgttaggggaaacccgggtacggtaacgggtcccgttaggtaaacctttaaccggttacgttaacggtcccgttaacgttacccggttactaaccgttaaggtacccggaccggtttaaacgggtcggtttaccttaccgtttccgtttacggtttaaccggttcgttaaccggtaaccggtcggggtaaaaccccgtacggtaaaccccgtacccgttaaccggttaccggtaaccgaaaccggacccgaaaacccgggttaccccaaaacccggtactccggttaacccgtttaacccg

SEQ ID NO: 417827 - DNA, 756 bp, Homo sapiens
  misc_feature: GZ8MTXP02I2ABH.19.78.H01.1.454.CMB.2.raw
  modified_base (197)..(197): a, c, t, g, unknown or other
  modified_base (207)..(207): a, c, t, g, unknown or other
  modified_base (225)..(225): a, c, t, g, unknown or other
  modified_base (262)..(262): a, c, t, g, unknown or other
tcagtactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctggtctcctggacngtcgtcaccntctcctgcactggaaccngcagtgatgttagaattctaacttgtctcgtgtacanatacaccaaataacaccccaaatcatctatttatgatcgaccactaacggccggtccccgttgtacggggttttactaacgttccgtcctttctcccgtacggtcctaccgaagttcacggtaccaacggccccggtcctccccgtagtaacctaacgttccgtacgttcggggaccttacccggtaggtaccgtagggaacggtacggtacgtacgttaacgttaacttacgtaccgttcgtccgttacgtaccttacgtacgttacgtacgtaccgttacggttaccgtttactttacgtttaccgtttacgtttacggtttaccggttaaccgggttaaccggttaccgggttaaacccggtaaccgggttaacccggttaaccccgttaacccggttaacccggttaacccggtaacccggtaaaccccggtaaaccccggtaacccccgtaacccccgttaacccgttacccgttacccgtttaccccg

SEQ ID NO: 417828 - DNA, 598 bp, Homo sapiens
  misc_feature: GZ8MTXP02GDYNU.19.78.H01.1.454.CMB.2.raw
  modified_base (206)..(206): a, c, t, g, unknown or other
  modified_base (221)..(221): a, c, t, g, unknown or other
  modified_base (227)..(227): a, c, t, g, unknown or other
  modified_base (244)..(244): a, c, t, g, unknown or other
  modified_base (254)..(254): a, c, t, g, unknown or other
  modified_base (276)..(276): a, c, t, g, unknown or other
  modified_base (279)..(279): a, c, t, g, unknown or other
  modified_base (284)..(285): a, c, t, g, unknown or other
  modified_base (287)..(288): a, c, t, g, unknown or other
  modified_base (294)..(294): a, c, t, g, unknown or other
  modified_base (299)..(299): a, c, t, g, unknown or other
  modified_base (312)..(312): a, c, t, g, unknown or other
tcagtactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtcgtggtctccgtggacagtcgtcacntctcctgcatgaacngcagtnatgtagaattctaactntctctgacanatacaaccaaataacacccaancantattnnannacatancgtcncgtaggttactanctcttctacctgtctactaagtcgtacgtacacgaccgtcctaccgtcaaacgtatcgtcgtacgtcctaccgtagcgtagagggaacgacggtctagtaacttaaactctacggtcttacgacttacgattacgtacgacgtacggtcttacgttcttaacgttcgttacgttacccgttagtaaacggttacgggaaaccgtaaacggttaccgacccgttacgtaaccgtacgaaccggtacccgtaaacggaacccctaacccgtaactcgtaccgttaccg

SEQ ID NO: 417829 - DNA, 510 bp, Homo sapiens
  misc_feature: GZ8MTXP01DIJDT.52.5.A05.1.454.CMB.2.raw
  modified_base (385)..(385): a, c, t, g, unknown or other
  modified_base (388)..(388): a, c, t, g, unknown or other
  modified_base (410)..(410): a, c, t, g, unknown or other
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccacatcacctgctctggacatcgattgggggatatacatgtttcctggtatcagcagaagccaggccagtctctgttctcctcatctataaagatgtcaagcggccctcgagggactccctgacgcgattctcgtggctccaattctaggaaatgcagcccatctgaccatcagcggaccagcctagngangagcgtgtactatacgtgtcgnggtcgtaggtacgtaggttggttgtggttcgttcgggcggtacggacgtagtcgttcgttccgttccgtaacgtcgaacgccgacgcctccgccccgtcg

SEQ ID NO: 417830 - DNA, 642 bp, Homo sapiens
  misc_feature: GZ8MTXP01EDCIP.52.5.A05.1.454.CMB.2.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtcgtccccaggacagacacgccaccatccacctgctctggacatcgagttgggggatatactagttgttcctggtatcagcagagccagccagtcctctgtcctcctcatactaataaagatgtacaacgccggtccctacgagggactccgcgacgcgtacttcctcgtcggacctccgtaaattccgtaggtaaactcgaccgaccgtccctaacgttcctacgaacccgtacgtaccgaacgggtaccccggggaacccctacgtacccgttaaggacggtacgtagacggtcggtacgtaacttacgttacgtcgtaccggaggtcggtagggtacgttagggttacggtttgtcgggtttcggtttacggttcggggacggttaccgacggtcgttccgttacccgttccgtaacgcccgaacgtccccgaggttccccgtccggttcccccgttccgg

SEQ ID NO: 417831 - DNA, 612 bp, Homo sapiens
  misc_feature: GZ8MTXP02GO49D.52.5.A05.1.454.CMB.2.raw
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgttcctggtatcagcagaagccaggccagtctcctgtctcctcatcctataagatgtacaagccggccctcgaggggactcccgtagacgcgtattcctacgtcggcctccgtaaattcgtacgggtaaatcgacacggccctaacgtcttacgaccctactcgaacggtccggaccccagcccgtaagtcggatggacggtcgtacgtacttacttaccgtagtccgtagggtcggtaggggactaaggttacgggtttgtcgttcggttttcgggacgggtacggggtaccaaacggtccgtacggtacccgttaccgtaaccggttccgaaccggacccgtaacggccgtacccggtacccccgtttcccggg

SEQ ID NO: 417832 - DNA, 516 bp, Homo sapiens
  misc_feature: GZ8MTXP02FTUNN.52.5.A05.1.454.CMB.2.raw
  modified_base (358)..(358): a, c, t, g, unknown or other
  modified_base (382)..(382): a, c, t, g, unknown or other
  modified_base (409)..(409): a, c, t, g, unknown or other
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagaagccaggccagtctcctgttctcctcatctataaagatgtacaagcggccctcagggactcccgtgagcgattctctggctcattctggaaatgcagccatcngaccatcagccggacccagcctancgatgaggctggactattactgtacgnggcgtgggactaggtaaggttgtgtcgtttcgggacgggtaacggacgaaacgtcgtacgaccgttccgaacgtacacggacccgaaggcctccggcccccttccgg

SEQ ID NO: 417833 - DNA, 545 bp, Homo sapiens
  misc_feature: GZ8MTXP02JP2A1.52.5.A05.1.454.CMB.2.raw
  modified_base (293)..(293): a, c, t, g, unknown or other
  modified_base (319)..(319): a, c, t, g, unknown or other
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatagtacattgtttcctggtatcagcagagccaggccagtctcctgtctcctcatctataaagntgtacaagcggccctcgaggactccngagcgtacttctctggctccgtattcgaggaaatgcacgcccactctacgaccatcgacgaccggacccagccctagtcgagttaggacggtctacggtacttacttaccgtgttacgaggtcggtaggtacgtaggttaggttgtcgttcgtttcgggacgggtacggtacgaacgtcgacgtaccgtccgaacgtcgacgaccgagtccgtccgacccttccgg

SEQ ID NO: 417834 - DNA, 600 bp, Homo sapiens
  misc_feature: GZ8MTXP02GC6CL.52.5.A05.1.454.CMB.2.raw
  modified_base (288)..(288): a, c, t, g, unknown or other
  modified_base (410)..(410): a, c, t, g, unknown or other
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgagttggggatatacatgtttcctggtatcagcagagccagccagtctctgtctctcatctataaagntgtacaacgccgcctacgagggactccctagacgccgtattcctctcggctcctaattccgtaggaaatcgacacgacccaatctacgacctactcgacggaccggaccctacgcccttagngagtagacgtatagtaccttattacgtagtaccgagggtaccggtagggtacgtaggttaggtttggtggttcgttttcggggacggttaacggggaccgtaacggtaccgtaccgtaacccggttaccgtaaccggttaccgaaccggtacccgtaacggtacccgtacccgtcccccgtttacccggg

SEQ ID NO: 417835 - DNA, 537 bp, Homo sapiens
  misc_feature: GZ8MTXP02FM6RE.52.5.A05.1.454.CMB.2.raw
  modified_base (295)..(295): a, c, t, g, unknown or other
  modified_base (312)..(312): a, c, t, g, unknown or other
  modified_base (334)..(334): a, c, t, g, unknown or other
  modified_base (378)..(378): a, c, t, g, unknown or other
  modified_base (385)..(385): a, c, t, g, unknown or other
  modified_base (388)..(388): a, c, t, g, unknown or other
  modified_base (393)..(393): a, c, t, g, unknown or other
tcagcgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatagtacatgtttacctggtatcagcagaagccaggccagtctcctgttctcctcatctataaagntgtcaaagcggcccctnagggactccctgagcgatctcnggctcatctggaaatgcagcactctgaccatcagcgggaacccncactagnganagagntgtatatacgtgtacgaggtcggtaggacgtaggttaggtttggtcggttcggtttcgggacgggtaacgggtaacgaacggtccgtacggtaccgttaccgtaacgtacgaccgacccgaacggtccgtccggccccgtccgg

SEQ ID NO: 417836 - DNA, 581 bp, Homo sapiens
  misc_feature: GZ8MTXP01BBY15.44.67.G01.1.454.CMB.2.raw
  modified_base (237)..(237): a, c, t, g, unknown or other
  modified_base (263)..(263): a, c, t, g, unknown or other
  modified_base (310)..(310): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactactancatgtatcaacacagaccagggcagcctcctaagttgctcatttacngggcatccggacccgggaagtcccggggtccccctggagcgattcaagtggcaggcgggtcgtgggacagtatttcactctacacatcgagcagcctgaccaaccgtgaaagtagtggggtacggtactaagtttaacttacgtgttaccaagtactaaattaagttaatacggtaccttccgtccgactacccgttcggaaccgtaaacggggaccacggttacgtaagggaagtaacttaaaacggacttggtaacgggttcctaacgg

SEQ ID NO: 417837 - DNA, 557 bp, Homo sapiens
  misc_feature: GZ8MTXP01ERPRA.44.67.G01.1.454.CMB.2.raw
  modified_base (340)..(340): a, c, t, g, unknown or other
  modified_base (469)..(469): a, c, t, g, unknown or other
  modified_base (506)..(506): a, c, t, g, unknown or other
tcagacagtatatacacgaccggtgctcgatttagagtatacatattgggtttgggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggccgccaggctcgagggagggctggagtgggtctcagtcatttanactggtgtatttcacataactagcagactccgtgaagggccgattcacatctcagggaccaattccaggtaacacggtttatacttacaaatcgaaacaacctgaagacggacgacgacacggcccgtntattactgtgcgagacaaggttcggcgtcgttcgggngttgggttaattagtttccgtttgacgttcgtcgggggttcctaaccgggg

SEQ ID NO: 417838 - DNA, 506 bp, Homo sapiens
  misc_feature: GZ8MTXP01B8LDD.44.67.G01.1.454.CMB.2.raw
  modified_base (266)..(266): a, c, t, g, unknown or other
  modified_base (312)..(312): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtattttatacacctccaaacaatcaccactacttancatggtatcaacacagaccaggcagcctctaagttgctcatttacnggcatcgaccggatccggggtcccctgagcgattcaagtgcagcgggtctgggacagattcactctcacatcagcagctgcaactgaagatggtggctagtttatactgtcagacaattatataggctaacctcgctaccgttcggaccaaggggacacgacgtggagaattaaacgaacttgtaacgctaacg

SEQ ID NO: 417839 - DNA, 562 bp, Homo sapiens
  misc_feature: GZ8MTXP01B28M9.44.67.G01.1.454.CMB.2.raw
  modified_base (436)..(436): a, c, t, g, unknown or other
  modified_base (514)..(514): a, c, t, g, unknown or other
tcagacagtatatacacgaccggtgctcgatttagagtatacatattgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttgggtccgccaggctccgaggggaagggctggagtgggtctcgagtcatttatactggtgatttcacataacctacgcagacctccgtgaacgggccgattccaccatcctccgagggaccaattcccaggtaaccacggtttancttacaaatgaacaacctggagaggcgacgacgacggccgtctattactgtgcgtagacgaagttcggcgcttcgggngttcggttaattagttccgtttgacctttcgtgggggccctaacgggg

SEQ ID NO: 417840 - DNA, 603 bp, Homo sapiens
  misc_feature: GZ8MTXP01A9WQ5.44.67.G01.1.454.CMB.2.raw
  modified_base (553)..(553): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctctgggctcaccgtcagcagcaactacatgagttcgggtccgcaggcctcgaggggaaggggctgggagtgggtctcgagtcaatttatacgtggtcgtatttcacataactacgcagactccgtgaagggccgattcacccatctccgagggacaattccgaaggtaacctacggtttatcttacaaaattcgaaacaaaccgtggaaagacgggaccgaacgacgaaccggtcccgttacttaacgttactggtgaaccgaagaccgaaacgttcgggacgtcgttacgggnggttggttaatttagtttcgtttagacctttcgtcggggccgtaacgggg

SEQ ID NO: 417841 - DNA, 549 bp, Homo sapiens
  misc_feature: GZ8MTXP01D2ZAT.44.67.G01.1.454.CMB.2.raw
  modified_base (343)..(343): a, c, t, g, unknown or other
  modified_base (428)..(428): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttggtcccgccaggctccgaggggaagggctggagtgggctcagtcatttanactggtgtatttcaacataactacgcagactccgtgaagggccattcacatctaccgagggacaattcccaggtaacacggttancttacaaatcgaaacacctgaagacggcgacgacgacggccgtctatactgtgcgagacaagttcggcgcttcggagttggttaattagttcgtttgacgttcgtcggggcctaaccgggg

SEQ ID NO: 417842 - DNA, 704 bp, Homo sapiens
  misc_feature: GZ8MTXP01BK9BW.44.67.G01.1.454.CMB.2.raw
  modified_base (499)..(499): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccagccgtgggggtccagagactctctgtgcagcctcgtggctcgaccgtcagcagcaactacagtgaggttcgggcccgccgaggccgtaccgaagggggaacgggctgggaggtcgggtctcgagttctaatttacgtacgtcggtgtatttcactattaaacctacgcaacgtaccgtccggtaggaacggggcctattcccaaccctattcccgaaccgaaggggtaaacctaaagtttaccccggaaagggtaaaccttacgggttttaanaccgtttaacgaaaattccggaaaacctaaacccgtaggggaaacggaacgggaccaaccggtaacccgaccggggtaccccgttacttaagttaccgtggagaaccgaagaacgtaacgggttcggaccgtcgttacggggagtttacggtttaatttacgttccgtttaacgctttcgggtcgggggaacccctaaaccgggg

SEQ ID NO: 417843 - DNA, 631 bp, Homo sapiens
  misc_feature: GZ8MTXP01CY92S.44.67.G01.1.454.CMB.2.raw
  modified_base (459)..(459): a, c, t, g, unknown or other
  modified_base (569)..(569): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaggtgtccagtgtgaggtgcggctgatggagtctggaggaggcttagtccagccgtggggggtcccagagactctcctgtgcagcctctgggctcaccgtcagcagcaactacatgagttgggtcccgccaggcctccgagggggaaggggctgggagtggggtctcagtcatttatactggtgtattttcaactataaacctacgcacgtacctcccggtaggaacggggcccgattccaccctatcctaccgagggaacaattccgaaggaactacgggtttanctttacaaattcgaaactaaccgtgaagacggcgaccgacgaccggtacccgtctaagttacctggtcgaacggaagaccgaaacgggttccgggacggtcgttcggggngtttgggtttaatttagtttccggtttgtaccgtttccggtgggggccccgtaaaccggggg

SEQ ID NO: 417844 - DNA, 556 bp, Homo sapiens
  misc_feature: GZ8MTXP01BQMI8.44.67.G01.1.454.CMB.2.raw
  modified_base (261)..(261): a, c, t, g, unknown or other
  modified_base (339)..(339): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctggcgagagggccaccatcaactgcaagtccagccagagtatttatacacctccaacaatcacactactancatgtatcaacacagaccaggcagcctctaagtcgctctatttacgtggcatccggaccggaagtcccggggtccccngagcgtatcgaagtcgcgaggcgggtgtcgggacagtactttcactctcacatcagcagctgacaactgaaagctggggtggacttagtttatacgtcgtcgatactaaattattaagtacggtacctccgtacgccgtaccgttcggaaccgtaaagggacgacgttaccgttaagggaactaaagtttaaacccggattcggtaacggctaacgg

SEQ ID NO: 417845 - DNA, 598 bp, Homo sapiens
  misc_feature: GZ8MTXP01DHCFE.44.67.G01.1.454.CMB.2.raw
  modified_base (237)..(237): a, c, t, g, unknown or other
  modified_base (263)..(263): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactactancatgtatcaacacagaccagggcagccctcctaagttgctcatttacgtgggcagtccgacccgggatcccggggtcccctggagcgatcaaggtgcaggcgggtctgggacaggtatttccacttctacaccatcagcacgccctagccaaaccgtgaaaacgtgtcggggtacggtacttaagttttacttacgttggttaccaaggtacctaaattattagtacggtacccttccgtacgttcctaccccgttcgggaacccgtaaggggttaacccacggaaccgttgggaaagtaacgtttaaaacggaccttggtaacgggcctaacgg

SEQ ID NO: 417846 - DNA, 672 bp, Homo sapiens
  misc_feature: GZ8MTXP01CLIR8.44.67.G01.1.454.CMB.2.raw
  modified_base (197)..(197): a, c, t, g, unknown or other
  modified_base (263)..(263): a, c, t, g, unknown or other
  modified_base (351)..(351): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggntgatggagtctggaggaggcttagtccagccgtgggggtcccagagactctcctgtgcagcctcgngggctcaccgtcagcagcaactacatgagttcggtccgcaggctccgagggggaaggggctgggagtcgggtctcgagtctaatttanacgtggttgatttcacataactacggcagaccgtccgtaggaacgggccgtattcgacccatcctaccgagggaacctaagttaccgaacgggaaacgttacgggtttaactacctttaaacaaaacgttacgaaaccgaaacccgttagggaacgaacggggaccgaacggaacccgaccgggtaccgttacctaagttacctaggtcgaacggaacgaacgaaagggttccggacgtccgttacgggttggttagggttttaattagttttccgggtttagtaccgtttcggtaacgggggaacccgttaacccggggg

SEQ ID NO: 417847 - DNA, 516 bp, Homo sapiens
  misc_feature: GZ8MTXP01C73V9.44.67.G01.1.454.CMB.2.raw
  modified_base (237)..(237): a, c, t, g, unknown or other
  modified_base (261)..(261): a, c, t, g, unknown or other
  modified_base (355)..(355): a, c, t, g, unknown or other
  modified_base (364)..(364): a, c, t, g, unknown or other
  modified_base (439)..(439): a, c, t, g, unknown or other
  modified_base (477)..(477): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctcaacatcaccactactancatgtatcaacacagaccaggcagcctcctaagtgctcatttactggcatcgaccggatccgggtccccctgagcgatcaagtgcagcgggtcngggacagtnttcactctcaccatcagacacgcctgacaacctgaagatggtcgactagtttatactgtcagtactaattattanacggtactcctcgacctaccgttcggaccgaagggacncgacgtggaagtaacgttaaacgacttggtcggctaacg

SEQ ID NO: 417848 - DNA, 572 bp, Homo sapiens
  misc_feature: GZ8MTXP01E49FL.44.67.G01.1.454.CMB.2.raw
  modified_base (303)..(303): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggaggcgtggcccccgaggtaggggggtccctgagactctcctgtgcagcctctggattcaccttgataatggaatatgcaggtgggtccnccaggctccgaggcgagggggctggagtgggtgcaggtgtgtcatttcagtgggagaaatcaaagtctacggtgattccggtaggacgggcccgattcaccatctaccagagacaacttaccgagaaacacagtgtctacttacaaatgaacacgcctagacgacctcgacggactacgggccgtgttattttggtgttcgagttactagtcttcgtttaccaaaattcggtactaacgttccggacgccgtcggggccgtaaccgggg

SEQ ID NO: 417849 - DNA, 757 bp, Homo sapiens
  misc_feature: GZ8MTXP01ERZEU.44.67.G01.1.454.CMB.2.raw
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggtacttttaaaggtgtccagtgtgaggtgcggctgagtggagtcgtggaggaggcttagtccagccgtcgggggtcccagagactctcctgtgcacgcctcgtggctcaccgtcagcagacaactacagtggtaggttcgggtcccgccgagggcctaccggaaggggggaagggggcgtggggtaggtcgggttctcgtagttctattttaacgtacgttggttagttactttacaactacttaaaccgtaccgctaacggtacccttccgggtagggtaaaccgggggtcccgtaactttacccaaccctacgttacccgttaccggaacggggtaaacctaaaccgtttacccgaaacggggttaaacccttaacgggtttttaactaccttaaactaaaacgttacggaaaaccctaaccgtagggaaacggacgggacccgaaacggaccgtaccgggtcccttacttaacgttacgtggacgaacgaacgaccgtaacgggttccggacgtcgttaggggttagtttcgggtttaattggttttccggtttggtaccgtttcggggtcggggaacccgttaaccggg

SEQ ID NO: 417850 - DNA, 543 bp, Homo sapiens
  misc_feature: GZ8MTXP01COPOH.44.67.G01.1.454.CMB.2.raw
  modified_base (237)..(237): a, c, t, g, unknown or other
  modified_base (261)..(261): a, c, t, g, unknown or other
  modified_base (528)..(528): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctcaacaatcacactactancatgtatcaacacagaccaggcagcctacctaagtgctctatttacgtggcagtccgaccggtatccggggtcccctgagcgattcgaagtggcaggcgggtcgtaggggacaggtactttcgactctcaccatccagcacgcctacgcaacctgaagatggggtgtacttaagtttataactgtacagtactaaattattagtacggactcccgtcgctaccgttcggaccgtaaggacgacgacgtaaggaataacgttaaacgngttagtcggctaacg

SEQ ID NO: 417851 - DNA, 661 bp, Homo sapiens
  misc_feature: GZ8MTXP01DPTSW.44.67.G01.1.454.CMB.2.raw
  modified_base (304)..(304): a, c, t, g, unknown or other
  modified_base (361)..(361): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtcgtggaggaggcttagtccagccgtgggggtcccagagactctcctgtgcagcctcgtgggctcaccgtcagcagcaactacatgagttcgggtcccnccgaggctccgaggggaaggggctgggagttgggtctcagtctatttatacgtggtntatttcaactataaacctacgcagtaccgtccggtagaaacggggccgtattcccaccgtataccgtacccgaagggaacctaaagttacccgaaaggtaaacctacgggtttaatccttaaacaaattacgaaacctaaacctagggaacggaacggaccgaaccgaaccgaccggtacccgttacttaagttaccgtggtgaacggaagaacgaacggttccggcgtcgttcgggttagttggtttaatttagttttccgtttaggaccgtttcgggtcggggttccgtaaccggggg

SEQ ID NO: 417852 - DNA, 576 bp, Homo sapiens
  misc_feature: GZ8MTXP01ER6SV.44.67.G01.1.454.CMB.2.raw
  modified_base (284)..(284): a, c, t, g, unknown or other
  modified_base (337)..(337): a, c, t, g, unknown or other
  modified_base (404)..(404): a, c, t, g, unknown or other
  modified_base (433)..(433): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctcgacccagtcctaccaaagtccctggctgtgtctcgtgggcgaggacgggccaccatacaactgacaacgtccagaccaagtagttaatttactaccacctaccaaacaatccacctactactancatgtatacaacacacgaccaggcacgcctactaagttgactactatttacgnggacacgtaccggacccgggtacgtcccgggtcccctggagcgtatcgaagtggcgaggtccgggtncgggtacaggtacttacactctacaactntcagcacgtcacgactaacagaacgtgtgggtcgtactttagttactacgttgacagtactaattatacggtactccgtctcgacctccgttcgaacgaagggacacgccgtaagactaacgtaacgagttggcttaagtccg

SEQ ID NO: 417853 - DNA, 519 bp, Homo sapiens
  misc_feature: GZ8MTXP01B5QMI.44.67.G01.1.454.CMB.2.raw
  modified_base (236)..(236): a, c, t, g, unknown or other
  modified_base (261)..(261): a, c, t, g, unknown or other
  modified_base (306)..(306): a, c, t, g, unknown or other
  modified_base (378)..(378): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctggcgagagggccaccatcaactgcaagtccagccagagtatttanacacctccaacaatcacactactancatgtatcaacacagaccaggcagcctcctaagtgctcatttacnggcatccgacccggaatccggggtccccctgagcgattcaagtgcaggcgggtctgggacagtattcactcncacatcagcacgcctgacactgaagatggtggctagtttatactgtcagacaaattattatacggtactcctcgctaccgttccggaccgaagggaccgacgactaagggacgtaagttaaacgacgttagtcgcgtaacg

SEQ ID NO: 417854 - DNA, 655 bp, Homo sapiens
  misc_feature: GZ8MTXP01EWU0A.44.67.G01.1.454.CMB.2.raw
  modified_base (242)..(242): a, c, t, g, unknown or other
  modified_base (266)..(266): a, c, t, g, unknown or other
  modified_base (273)..(273): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgaggacgggccaccatcaactgcaagtccagccagtagttatttanacacctacaacatcacactactancatgtancaacacagaccagggcacgcctactagttcgctctatttacgtggcagtccggacccgggaacgtcccggggtccccctggacgcgtatccgaaggtcgggcgagggtccgggtcgtggggactaggtactttcccaccttccgtaccaacctataccgacgccgaacgtcccgtacgaccaaaccgtaggaaagtacgtggggtcggtaacttaggttttaacttacgtcggtaccaggtaactaaatttacgttacgtacggtccttccgtccgttacctacccggttccgggaaaccgtaacggggaacccgttacgggttaccgtaaggggtaaactaacgttaaaaccggacgttacgggtcggttccggtaacccg

SEQ ID NO: 417855 - DNA, 592 bp, Homo sapiens
  misc_feature: GZ8MTXP01CKC9J.44.67.G01.1.454.CMB.2.raw
  modified_base (340)..(340): a, c, t, g, unknown or other
  modified_base (410)..(410): a, c, t, g, unknown or other
  modified_base (515)..(515): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagtttttggctgagcgtggttcgtccttaggttggacttttaaaaggtgtccagtgtgaggtgcggctgatggagtctggaggaggcttagtccagccgtggggggtcccagagactctcctgtgcagccctcgtgggctcaccgtcagcagcaactacagtgagttgggtcccgcaggctcgaggggagggctgggagtgggtcncgagtcatttatacgtcggtgtatttcacataacctcgcagacctccgtagacggggcctattccacctntactcgagggaactagttacccaagggaactacggtttatcgttaacaaagttcaaacgacgtaggacgaggccgacgacgaccgggtcctacgtatttaccggnggtgaacgacgacgacggcggcgtcgttcggttgtttgttaattcgtttcgttcgtcgttcggcgggttaaccgcgg

SEQ ID NO: 417856 - DNA, 557 bp, Homo sapiens
  misc_feature: GZ8MTXP01CYLBJ.44.67.G01.1.454.CMB.2.raw
  modified_base (264)..(264): a, c, t, g, unknown or other
  modified_base (427)..(427): a, c, t, g, unknown or other
  modified_base (518)..(518): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctggcgagagggccaccatcaactgcaagtccagccagagtatttatacacctccaaacaatcaccactacttancatggtatcaacacagaccagggcagcctcctaagttgctcatttactgggcatccggacccggaagtcccggggtcccctggacgcgtattcgaaggtggcgaggcgggtcctggggactaggtatttcactctcaccatcagcagcctgaccaacctgaanacgttgggtggtcttaagtttacgttactgtcagtactaattattaagtacggtaccttcctcgactacccgttccggaccgaacgggacncgacgtggaacgtaagttaaacgacgttgtcggctaacg

SEQ ID NO: 417857 - DNA, 586 bp, Homo sapiens
  misc_feature: GZ8MTXP01AH5CD.44.67.G01.1.454.CMB.2.raw
  modified_base (300)..(300): a, c, t, g, unknown or other
  modified_base (452)..(452): a, c, t, g, unknown or other
  modified_base (535)..(535): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccnccaggctccgagggagggctgggagtgggtctcgagtctatttatacgtggtgtatttcactataaacctcgcagtacctccggtgaacggggccgaattcaaccctatcctaccgaagggacaattacccgaaggtaacctacggtttaancttacaaatgaaacaactgagacggcacgacacggccgtactattacctgtgaaccgtagacgtaggttcggcgcgttcgggngttgggtttaacttagtttcgtttgacgtttcgtcgggggcctaaccgggg

SEQ ID NO: 417858 - DNA, 600 bp, Homo sapiens
  misc_feature: GZ8MTXP01ECOP0.44.67.G01.1.454.CMB.2.raw
  modified_base (241)..(241): a, c, t, g, unknown or other
  modified_base (270)..(270): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgagagggccaccatcaactgcaagtccagccagtagttattttanacacctaccaaacaatcaccactacttancatgtatacaacacagaccaggcagccctactaagtcgctctatttactggacatccggaacccgggaacgtcccggggtcccctggagcgtacttcgaaggtcggcgacggtcggggtcgtgggacaggtactttcacttctaccaacctaatcgaagaccgacggtacctacggaccaaacccgttaggaaacgtaagttggggtcggtaccgttaggttttaactacgtgtacgagtaactaattacttagtacggtctcctcgcctaccgttcgacgtaaggacgacgacgtggaataacgttaaacgacgttaggtcgcgtaacg

SEQ ID NO: 417859 - DNA, 608 bp, Homo sapiens
  misc_feature: GZ8MTXP01EH5KS.44.67.G01.1.454.CMB.2.raw
  modified_base (342)..(342): a, c, t, g, unknown or other
  modified_base (359)..(359): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtggctcaccgtcagcagcaactacatgagtggtccgcaggctccgaggggagggctgggagtgggtctcgagtcatttanacgtggtgtatttcaanactaactacgctagacctccgtgaacgggccgattccacctatcaccgagggaccaagttcccgaaggtaactacggtttatcttaacaaattcgaaactaacccgtggaaggacggaccgaacgaccgaccgggtcccttacgtaattaccgtggcgaacgtaagaccaaggttccgggactcgttacgggagttggtttaattacgtttccgtttagacgtttcgtcgggggaaccctaaccggggg

SEQ ID NO: 417860 - DNA, 614 bp, Homo sapiens
  misc_feature: GZ8MTXP01EK0DE.44.67.G01.1.454.CMB.2.raw
  modified_base (265)..(265): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtattttatacaccttacaacaatcacactacttancatgtatcaacacagaccaggcacgcctactaagttgctctatttactgggcagtccgacccgggaacgtccggggtccccctggagcgattcgaagtggcgaggtcgggtcgtgggacaggtatttcgactctacaccatcgagaccagccctacgaccaaacccgtagaaacgtaagttcggggtggtaccgttaaggttttactttacccgttggtaccctaaggtaccttaaaattatttaacgtaacggtacccttaacccgtcgacctacccgttccgggaccgtaaacgggccgttacgacgtaaggaagtaacgtttaaacgaccgttaggtcgcgtaacg

SEQ ID NO: 417861 - DNA, 613 bp, Homo sapiens
  misc_feature: GZ8MTXP01BITLX.44.67.G01.1.454.CMB.2.raw
  modified_base (238)..(238): a, c, t, g, unknown or other
  modified_base (261)..(261): a, c, t, g, unknown or other
  modified_base (314)..(314): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgaggagggccaccatcaactgcaagtccagccagagtatttanacacctcaacatcacactactancatgtatacaacacagaccaggcacgccctacctaagttcgctctatttacgngggcagtccggaacccgggtaacgtcccggggtccccctggacggcgtattcgaaggttcggcgagggcggggtcgtcggggaactaggtactttcactctaccacatcagcaggcctgaccaactagaacgtacgtggggtaggtacgttagttttaactacgtcgtcgaagtactaaattagtttaatacggtaacccttccgtacgttaccctaccgttccggaccgtaaacggaccgacgttaacggtaagggaacgtaacgtttaaaaccggaacgttcggtggttcgtaaccg

SEQ ID NO: 417862 - DNA, 578 bp, Homo sapiens
  misc_feature: GZ8MTXP01DVT7C.44.67.G01.1.454.CMB.2.raw
  modified_base (238)..(238): a, c, t, g, unknown or other
  modified_base (264)..(264): a, c, t, g, unknown or other
  modified_base (386)..(386): a, c, t, g, unknown or other
  modified_base (399)..(399): a, c, t, g, unknown or other
  modified_base (404)..(404): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtcccctggctgtgtctctgggcgagagggccaccatcaactgcaagtccagccagagtatttanacactccaacaatcaccactacttancatgtatacaacacagaccaggcacgcctactaagtgacttctatttacgtggcagtccggacccggtagtcccggggtcccctggacgcgtactcgaagtggcgagcgggtctaggggacngtatttcacttcncaccntcagcacgcctagccaaacctgaaagtcgttggggtggtacttagtttataccgtgtcaagataaattattatacggtacttccctcgacctacccgttacggaccgaaacggggttaccacggttacgtaagggaaacttaacgttaaaaccggacttggtaacggaactccg

SEQ ID NO: 417863 - DNA, 610 bp, Homo sapiens
  misc_feature: GZ8MTXP01APLT1.44.67.G01.1.454.CMB.2.raw
  modified_base (303)..(303): a, c, t, g, unknown or other
  modified_base (349)..(349): a, c, t, g, unknown or other
  modified_base (450)..(450): a, c, t, g, unknown or other
  modified_base (457)..(457): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctcgtgggctcaccgtcagcagcaactacatgagttcgggtccnccaggctccgaggggagggctgggagtgggtctcgagtcatttacncgtggtgtatttcactataaactacgcagtacctccggtagaacgggccgattccaccatcctacgagggtacaacttaccgaaggtaacctacggtttanaccttanaaattacgaaaccaactggaagacggccgaacgacgaccggccgtctacgttactgtcgaacgacgacgaacggttccggacgtcgttacgggttgttaggggtttaattacgtttcggttgtacgttcggttcgggggaaccctaacggggg

SEQ ID NO: 417864 - DNA, 536 bp, Homo sapiens
  misc_feature: GZ8MTXP01EYS2Q.44.67.G01.1.454.CMB.2.raw
  modified_base (239)..(239): a, c, t, g, unknown or other
  modified_base (265)..(265): a, c, t, g, unknown or other
  modified_base (420)..(420): a, c, t, g, unknown or other
tcagacagtatatacacgaccggtgctcgatttagagtatacatattgggtttgggggagctacaacaggcaggcaggggcagcaagatggtgttgcagaccccaggtcttcatttctctgttgctctggatctctggtgcctacggggacatcgtgctgacccagtctccaaagtccctggctgtgtctctgggcgagagggccaccatcaactgcaagtccagccagagtattttanacacctccaacaatcaccactactancatgtatcaacacagaccagggcacgtcctacctaagttgctcatttactgggcacgttcgaccccgggaatcccggggtccccctgagcgattcgaagtggcaggcgggtctgggactagatttcactctcacatcagcagcctgcacctgaanatgggtgtctagtttctactgtctagactaatattagtacgtactaacctcgttccaccgttcgacgaacggacgacgacgtaagggataacgttaacgacgttgtgttaaccgtg

SEQ ID NO: 417865 - DNA, 653 bp, Homo sapiens
  misc_feature: GZ8MTXP01B6VRW.44.67.G01.1.454.CMB.2.raw
  modified_base (299)..(299): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctgattcacttgataatggaatatgcaggtcggtccncaggcctccgaggcggaggggctgggaggtggggtggcgagggttgtgtctatttcgagtgggaaggtaaatcgaaagttcgtaacgggtgtaacgtttcccggttagggacgggtcccgtattccaacctacgtcctaccagacgaactaacgttaccgaagaacacgagttcgtactacttacaaagtacgaacacgcctagaacgaccgtcgaacggacgtaaccgggtcccgttgttaagttttggtacgttcggtaacgttacgttacttcgttacgtttaccttaaaacgtttcggttacgtaacgtttcggaccggttcccggttcgggggaacccgtaacccgggg

SEQ ID NO: 417866 - DNA, 790 bp, Homo sapiens
  misc_feature: GZ8MTXP01ET4H8.44.67.G01.1.454.CMB.2.raw
  modified_base (577)..(577): a, c, t, g, unknown or other
  modified_base (672)..(672): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcccgtgtcgcacgtcctcggtcggtcctccgtacccgtcacgacacgacctaaactaactagtacggtacggttccgggccccgaccggacggtccctaccggggaaggggggaacgggtcggtagggtagggttcgggttcctacgtacggttacttaagtttaacgtacgttgggtactttactttacaactacttaaacccgtacgcgtaaccgtaccgttacccgggtaagggaaccggggtcctaacttacccaacctagttaccccgaccggaaaggtaaccttaacgttaaaccccgaagggttaaaccgttaacgttttanacccgttaaaaacaaacgtaaccgaaaacccgtaacggtagggaaacggaccggaccgaaaccgaccggtaccggttaccttatacgtttacggngtacggaacgtaacgaacgtacgggttccggcgtacgggttacggttagtttagtttaactttcggtttcgggtttaacggtacccgttcgggggtaaccggggaacccggtaaccgg

SEQ ID NO: 417867 - DNA, 671 bp, Homo sapiens
  misc_feature: GZ8MTXP01A4D30.44.67.G01.1.454.CMB.2.raw
  modified_base (368)..(368): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtggggggtcccagagactctcctgtgcagcctcgtgggctcacccgtcagcagcaaactacatgaggttcgggtcccgccaggcctccgagggggaagggggctgggagtgggtctcgagtctaatttatactgggttntacttcactactaactacgcacgccgtcggaggacggtcgtataccacctatccgtacgaacggaacctaacgtaccgaaggtaaccgttacgtttactacttaacaaagtacgaaaccgtaacgtggaacggacgggaccgaaccggtaccgtaccgggtacccttacgttaaacgttacgtcggtacggaacgaacggttaacgtacggttccgggacgtccggttagggttaggtttacggtttaatttcggtttcgtttacggtaccggttcgggtccggggttaacccggtaacgggg

SEQ ID NO: 417868 - DNA, 609 bp, Homo sapiens
  misc_feature: GZ8MTXP01EKED0.44.67.G01.1.454.CMB.2.raw
  modified_base (280)..(280): a, c, t, g, unknown or other
  modified_base (334)..(334): a, c, t, g, unknown or other
  modified_base (455)..(455): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctcgacccagtctaccaaagtccctggctgtgtctcgtgggcgaggacgggccaccatcaactgacaagtccacgccagagttattttactaccacctaccaaacaatccacctactacttancatgtatacaacacacgaccgaggcacgcctactaagtcgactactatttacgnggctacgtccggaacccgggtaacgtcccggggtacccctggacgtcgtatcgaaggtggcgagggtcgggtcgtgggacagtcttcgactctacacgctcacgcacgctcgactaaccgngtaaagtcgtggggtagtcgttaagtttactacgtgtacgtagtactaattagttaacgtacggtaaccctcgtccgttaccgtacccgttcgggaaaccgaacggttacgcggttacgtaaggaactaagtaaacgacttggtcgcgtaaccg

SEQ ID NO: 417869 - DNA, 574 bp, Homo sapiens
  misc_feature: GZ8MTXP01AIBML.44.67.G01.1.454.CMB.2.raw
  modified_base (240)..(240): a, c, t, g, unknown or other
  modified_base (266)..(266): a, c, t, g, unknown or other
  modified_base (357)..(357): a, c, t, g, unknown or other
  modified_base (502)..(502): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctgacccagtctccaaagtccctggctgtgtctcgtggcgagagggccaccatccaactgcaagtccagccagagttatttanacacctccaacatcaccactacttancatgtatcaacacacgaccaggcacgccctactaagttcgctctatttacgtggacacgtaccggacccgggaacgtcccggggtcccccngagcgtattcgaagtgcgaggtcgggtcgtgggactagtacttcactctaccacatcagccagcctacgaccaacgtacgaagtatcggggtgtacgttagttacttacgtgtcgacgtactaatattacgtacggactaacccncgttacctacccgttcggacccgtaagggaccgacgacgtaacgagtaacgtaaacgcttaggtgcgtaacg

SEQ ID NO: 417870 - DNA, 888 bp, Homo sapiens
  misc_feature: GZ8MTXP01A7JZC.44.67.G01.1.454.CMB.2.raw
  modified_base (266)..(266): a, c, t, g, unknown or other
  modified_base (309)..(309): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggagcgtggccccgagggtacgggggtccctgagactcctcctgtcgcagcctntgattccaccttgataatggaaatatgacaggtcgggtccccncgtaggcctaccagggcggagggggctgggacggtggggtggcgtagggttgtaggtctagttttcgacgttagggaaacggtaaatcgtaaaggtacttacggggtcgtagttacccgggttgaacgggggtccctatttaccaacccgtacttacccgtacccgaaaggaccggtaacctaaacgtttaccccggaaaacgtaaacccgaaaccgttaaacgggttccgtttaaccgtttaccgttttaaaccccaaaaagggtttaaccggtaaaaccgaaacccggtaccccgtttaagggtaaacccgaacccccgttaacccggtaaacggggaacccggtaaccccgggggtaacccggttttggtttaaacccggtttttttgggaaccggttaccgggtaaacggttaaacccgtttaaacggtttaccccgtttaaccggggttttttaaaaccccaaaaaacggtttttccccggggtttaaccttaaaaccggtttcccggggtaaaccccggttcccggggttttaaccccgggggggaaccccggttaaaaacccccccgggggg

SEQ ID NO: 417871 - DNA, 643 bp, Homo sapiens
  misc_feature: GZ8MTXP01AG3KW.44.67.G01.1.454.CMB.2.raw
  modified_base (277)..(277): a, c, t, g, unknown or other
  modified_base (359)..(359): a, c, t, g, unknown or other
  modified_base (377)..(377): a, c, t, g, unknown or other
  modified_base (567)..(567): a, c, t, g, unknown or other
tcagacagtatatacacgaccggtgctcgatttagagtatacatattgggtttgggggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtcgtggaggaggcttagtccagccgtggggggtcccagagactctcctgtgcagcctctgggctcaccgtnagcagcaaactacagtgagttgggcccgccgtaggccgtccgagggggaggggctgggaggtgggtctcgagttcagtttanacgttggtgtatttcaanattaaacctacgcagacccgttcgtaggaacgggtccgattacccacactcctaccgagggtaacctagttacccgagggtaaacctcggtttatcgttaacaaattacgaacctaacgtggagacgggcgaaccgacgaccggtcccttagtattacgtggtcgcgaagttacgaacggcggtacccgngttaccgggttaggttggtttaaacctttgtttcggttttcggactttccggggcggggttaaccgtaacccgggg

SEQ ID NO: 417872 - DNA, 631 bp, Homo sapiens
  misc_feature: GZ8MTXP01ENX0R.44.67.G01.1.454.CMB.2.raw
  modified_base (271)..(271): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgagagggccaccatcaactgacaagtccagccagtagttattttactacacctaccaaacactcaccactactancatgtatacaacacagaccaggcacgccctacctaagttcgctactatttacgtggacacgtcccggaaccgggtaacgtcccggggtccccctggagcgacttacgaagtggcgaggtccgggtcgtagggactaggtacttttccacttcctacacctatcgagaccacgtcctacgaccaaacgtgaaacgtacgtggggtggtacttaagttttacttacgtgtctagaactaaagttacgttaactacggtacctccgtaccgttcctacccggttcggaaccgaaacggggaccgaacggttacgtaagggaaacgtaacgttaaaaccggacgttgggtaacgttccgtaacg

SEQ ID NO: 417873 - DNA, 535 bp, Homo sapiens
  misc_feature: GZ8MTXP02F9FM3.44.67.G01.1.454.CMB.2.raw
  modified_base (472)..(472): a, c, t, g, unknown or other
tcagacagtatatacacgaccggtgctcgatttagagtatacatattgggtttgggggagaggagcccagcactgggattccgaggtgtttccattcggtgatcagcactgaacacagaggactcaccatggagttttggctgagcgtgggttctccttgttggacttttaaaaggtgtccagtgtgaggtgcggctgatggagtctggaggaggcttagtccagcctgggggtcccagagactctcctgtgcagcctctgggctcaccgtcagcagcaactacatgagttggtccgccaggctccgagggaaggggctggagtgggtctcgagtcatttatactggtgatttcacatactacgcagactccgtgaagggccgattcaccatctccagggacaattccaggaacacggtttatcttacaaatgaaacaacctgagaggcgacgacgacggccgtctattacngtgcgagacaagtcggcgcgtcggagtggttaatattcgttgactttcgtgggcctaacgggg

SEQ ID NO: 417874 - DNA, 507 bp, Homo sapiens
  misc_feature: GZ8MTXP02IP045.44.67.G01.1.454.CMB.2.raw
  modified_base (304)..(304): a, c, t, g, unknown or other
  modified_base (314)..(314): a, c, t, g, unknown or other
  modified_base (346)..(346): a, c, t, g, unknown or other
  modified_base (358)..(358): a, c, t, g, unknown or other
  modified_base (391)..(391): a, c, t, g, unknown or other
  modified_base (444)..(444): a, c, t, g, unknown or other
tcagacagtatatacacgaccggtgctcgatttagagtatacatattgggtttggggagctacaacaggcaggcaggggcagcaagatggtgttgcagacccaggtcttcatttctctgttgctctggatctctggtgcctacggggacatcgtgctgacccattctccaaagtccctggctgtgtcctcgtgggcgagagggccaccatcaactgcaagtccagccagagtatttatacacctccaacaatcaccactacttatcatggtatcaacacagacccagggcagcctcctaagttnctcatttacnggcatcgacccgggaatccggggtcccctgancgattcagtgcngcgggtctggacagatttcactctcaccatcancagcctgcaaacctgaaagatgtaggctagtttatactgtcagcaaatattanaggactcctcgcaccgttcggacaacggggacacgactggataacttaaacgatgtaggctag

SEQ ID NO: 417875 - DNA, 656 bp, Homo sapiens
  misc_feature: GZ8MTXP02I2NNH.44.67.G01.1.454.CMB.2.raw
  modified_base (351)..(351): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagcgtggttcgtcctaggtggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccagggaaggggctggagtgggtctcagtcatttatactgggtntattcactatacctacgcacgactccggtagaacgggccgtattccacctactcctacgaacgggtactaaacgttaccgaacggtaaacgtaacggtttacttacttaactaaaactacgaaacgtaaaccgtacgtaacggacgggaccggaaccgaaccggaccggtacccgtacgttaacgttacgtacgtacgtacggacgaaacgaacggtacggtaccggtaccgtacggtacggttaggtttaagtttacgtttacggtttacgttacgtttacggttcggggtaccggtaaccggg

SEQ ID NO: 417876 - DNA, 503 bp, Homo sapiens
  misc_feature: GZ8MTXP02JA2FA.44.67.G01.1.454.CMB.2.raw
  modified_base (296)..(296): a, c, t, g, unknown or other
  modified_base (326)..(326): a, c, t, g, unknown or other
  modified_base (411)..(411): a, c, t, g, unknown or other
  modified_base (443)..(443): a, c, t, g, unknown or other
tcagacagtatatacacgaccggtgctcgatttagagtatacatattgggtttgggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtccctgagactctcctgtgcagcgtctggattcaccttcagtacctatggcatgcactggtccnccaggctccaggcaaggggctggagtgggnggcacttatatggtatgatggaaagtaataaatactatgcagactcgtagacgggcatcacatctcagagacaattccaagaacncgactgtatctgacaaatagaacagcctgagngaccgaggacacggctgtgtattacgtgtcgcgaggaacatattgagtacacctactacg

SEQ ID NO: 417877 - DNA, 554 bp, Homo sapiens
  misc_feature: GZ8MTXP02HCOAQ.44.67.G01.1.454.CMB.2.raw
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgaggggaaggggctgggagtggggtctcgagtcatttatactggtgatttcacatactacgcagactccgtagaacgggccgattcaccatcctccagggacaattccaggaactacggttatcttcaaaatgaaacaacctgagaggcgacgacacggccgtctatactgtcgcgagacaacgtcggacgtcgtcggagtggttaattacgtttcgtttagtacttcgtcgggggcctaacgggg

SEQ ID NO: 417878 - DNA, 552 bp, Homo sapiens
  misc_feature: GZ8MTXP02HXSH4.44.67.G01.1.454.CMB.2.raw
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggctcaccgtcagcagcaactacatgagttggtccgccaggctccgagggaagggctggagtgggtctcagtctagtttatactggtgatttcactatactacgcagactccgtgaaggccgattcaccatctccagggacaattccaggaacacggtttatcttacaaattcgaaacacctgagaggacgacgacacgggcctctattactgtcgacgagacaaacgtcggcgtacgtcggaagttggtaatttacttcgtttgactttcgtacggggcctaacgggg

SEQ ID NO: 417879 - DNA, 572 bp, Homo sapiens
  misc_feature: GZ8MTXP02I6LR4.44.67.G01.1.454.CMB.2.raw
  modified_base (272)..(272): a, c, t, g, unknown or other
  modified_base (296)..(296): a, c, t, g, unknown or other
  modified_base (433)..(433): a, c, t, g, unknown or other
  modified_base (491)..(491): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctgggggtcccagagactctcctgtgcagcctctgggctcaccgtnagcagcaactacatgagtggtccncaggctccgaggggaaggggctgggagtggggtctcgagtctatttatactggtgatttcgacatacctacgcagacctccgtgaacggggccattcaccatctccgagggacaagttccaaggaactacggtttancttacaaattcgaaacaaccgtgagagggaccgaacgacgacggccgtactattaccngttgacgagaacaacggtcggcgtcgtacggagttggttaattagttccgtttagacgtttcgcggggtcctaaacggggg

SEQ ID NO: 417880 - DNA, 541 bp, Homo sapiens
  misc_feature: GZ8MTXP02F5X09.44.67.G01.1.454.CMB.2.raw
  modified_base (260)..(260): a, c, t, g, unknown or other
  modified_base (348)..(348): a, c, t, g, unknown or other
  modified_base (422)..(422): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctntgggctcaccgtcagcagcaactacatgagttggtccgcaggctccgaggggaagggctggagtgggtctcagtcatttatactggtntattcacatactacgcagactccgtgaaggcgattcaccatctccgaggacaacttccaggtaacacggtttanacttacaaatgaaacaactgagaggacacgacacggcctctatactgtgcgagaccaaggtcgcgcgtcggagttggttaatttagttcgtttagaccttcgtcggggcctaaacgggg

SEQ ID NO: 417881 - DNA, 612 bp, Homo sapiens
  misc_feature: GZ8MTXP02HIJUS.44.67.G01.1.454.CMB.2.raw
  modified_base (237)..(237): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctcaacatcaccactactatcatgtatcaacacagaccaggcagcctcctaagtgctcatttactggcacgaccggaccggacggtccggtcccagacgctactcgaggtcgcgacggtcggtcgaggacagtacttccactcaccactactacacgacgaccgtccgtacgacctaaccgtagaaagtcgttaggtcgtacgtttaacgtttacttacgtcgtacgtacgtaaacttaaatttacgttaaagtaaccgtacccgttacccgtccgtaacccgttacccggtacggaaaccggaacggtaccgaaccggtacgtaaggtaaacgtaaaacgttaaaacgtaacgtacggtacgtacgaccg

SEQ ID NO: 417882 - DNA, 729 bp, Homo sapiens
  misc_feature: GZ8MTXP02GAQT8.44.67.G01.1.454.CMB.2.raw
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttgggtccgccaggctccgaggggaaggggctgggagtggggtctcgagtcatttatacgtggtgatttcactatactacgcagacctccggtagaacggggtcccgtaatttcccaaccctattccctacccgaagggggtaacctaaacgtttcccgaaacgggtaaaaccttaaccgggtttttaactaccgtttaaccaaaaagttacggaaaacctaaacccgttagggaacggaacggggaccgaaaccggaccgaaccggggtcccggttacttaacgtttacgtacggttcggaccggaacgtaaccgtaaacgggttccgggacggtcccccggttacggggtacggttttacggggtttaattttaacggttttccggttttacggtaaccgttttccgggtacggggggtaccccgtaaacccggggg

SEQ ID NO: 417883 - DNA, 538 bp, Homo sapiens
  misc_feature: GZ8MTXP02FORDC.44.67.G01.1.454.CMB.2.raw
  modified_base (237)..(237): a, c, t, g, unknown or other
  modified_base (310)..(310): a, c, t, g, unknown or other
  modified_base (358)..(358): a, c, t, g, unknown or other
  modified_base (390)..(390): a, c, t, g, unknown or other
  modified_base (416)..(416): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactactatcatgtatcaacacagaccagggcagcctcctaagttgctcatttacngggcatccgacccgggaatccggggtccccctgagcgtttcagtggcnggcgggtctggggacagatttcactctcaccntcagcagcctgccaacctgaagatgnggactagtttatactgtacagacaattattatagactcctcgccaccgttcggaccaaacgggaccaacggaccgtaggaacgtaaacgttaaaacgaaaccgtggtaggaccgtagaaccc

SEQ ID NO: 417884 - DNA, 495 bp, Homo sapiens
  misc_feature: GZ8MTXP02FP8RT.44.67.G01.1.454.CMB.2.raw
  modified_base (236)..(236): a, c, t, g, unknown or other
  modified_base (310)..(310): a, c, t, g, unknown or other
  modified_base (410)..(410): a, c, t, g, unknown or other
  modified_base (475)..(475): a, c, t, g, unknown or other
tcagacagtatatacacgaccggtgctcgatttagagtatacatattgggtttggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactacttatcatggtatcaacacagaccagggcagcctccaagttgctcatttacngggcatcgaccggaatccggggtcccctgagcgattcagtggcagcgggtctggggacagatttcactctcacatcagcagctgcaaacctgaaagatgnggcagtttattactgtcagcaatatataggactctcgcaccgttcgcaacgggacacgactgganacttaaacgatgtaggctag

SEQ ID NO: 417885 - DNA, 619 bp, Homo sapiens
  misc_feature: GZ8MTXP02FSTR9.44.67.G01.1.454.CMB.2.raw
  modified_base (261)..(261): a, c, t, g, unknown or other
  modified_base (345)..(345): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcngggctcaccgtcagcagcaactacatgagttggccgcaggctccgagggagggctggagtgggtctgagtcatttatactggtntatttcactatactacgcagactccgtagaacgggccattccaccatccctcgaaggactaagttcccgaaggtaactacggtttatacttaacaaatacgaaacctaaccgtggacgacgggaccgaaccgaaccgaccggtcccgttacttacttaccgtggtacgacgaagaccgtaaagggtccggcggtaccgtacgggtagtttagggttaactttacgtttccggtttaggtaccgtttcggaccgggggtaccgtaaacccggggg

SEQ ID NO: 417886 - DNA, 585 bp, Homo sapiens
  misc_feature: GZ8MTXP02I96MF.44.67.G01.1.454.CMB.2.raw
  modified_base (432)..(432): a, c, t, g, unknown or other
  modified_base (498)..(498): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctctgggctcaccgtcagcagcaactacatgagttggtccgccaggctccgaggggaagggctggagtgggtctcgagtctatttagtactggtgatttcactattactacgcagactccgtagaacggggccattcaccatcctcgaggactaatcccaggaactacggtttanctttacaaatacgaaaccaacctgaacgagggaccgaacgaccgaacgggtcccgttatacttagngtagaccgtagaccgaaaggtccggctccgtacggtagttggttaattacgtttcgtttcgacgtttcgtcggggacctaaccgggg

SEQ ID NO: 417887 - DNA, 539 bp, Homo sapiens
  misc_feature: GZ8MTXP02JIDIY.44.67.G01.1.454.CMB.2.raw
  modified_base (309)..(309): a, c, t, g, unknown or other
  modified_base (403)..(403): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacaccttcaacaatcaccactactatcatgtatcaacacagaccaggcagcctcctaagttgctcatttacnggcatcgacccggatccggggtcccctgagcgattcagtggcagcgggtctgggacagattcactctcaccatcagcagcctgacacctgaagntgtggctagtttattacgtgtacagctaaattattagtaggaccttaccgtcgcctaacccgttcgggaccctaaaggggaccaccggaactaaggaacgtaaacgttaaaaccgaacgttggtaacggcttacgg

SEQ ID NO: 417888 - DNA, 639 bp, Homo sapiens
  misc_feature: GZ8MTXP02I8OZE.44.67.G01.1.454.CMB.2.raw
  modified_base (239)..(239): a, c, t, g, unknown or other
  modified_base (315)..(315): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgaggagggccaccatcaactgcaagtccagccagagttatttanacacctccaacaatcaccactactatcatgtatcaacacagaccagggcagccctacctaagttgctcatttacgnggacagtccggacccgggaacgtcccggggtccccctaggacgcgtactttcgaggttcggcgacgggtcggggtcgtagggggaccaggtactttccaccttctaccacctatcgaagccacgtccgtagaccaaaccgtgaaacgtagttggtacggtaccttaagttttacgttaaccgtgtacgaacgtactaaattattaagtaacggtaccttaccgtaccgtacctacccggttcggaaccgaacggggaacctaacggtaccgtaagggtaacgtaaaacgtttaaaaccgacgttacgggtacgtacgtaaccgg

SEQ ID NO: 417889 - DNA, 559 bp, Homo sapiens
  misc_feature: GZ8MTXP02JVPZC.44.67.G01.1.454.CMB.2.raw
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggcctccgaggggaaggggctgggagtggggtctcagtcatttatacgtggtgatttcactatactacgcagactccggtgaacggggccgattccaccatctccgagggacaattccaaggaactacggttatcttacaaatgaaacactgagaggacgacgacacggccgtctattactgtgcgagacaacggtcggacgcgtcggagttggttaattagtttcgtttgactttcggtcggggcctaaaccgggg

SEQ ID NO: 417890 - DNA, 550 bp, Homo sapiens
  misc_feature: GZ8MTXP02GOTR6.44.67.G01.1.454.CMB.2.raw
  modified_base (236)..(236): a, c, t, g, unknown or other
  modified_base (261)..(261): a, c, t, g, unknown or other
  modified_base (306)..(306): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtggcgagaggccaccatcaactgcaagtccagccagagtatttanacacctcaacaatcaccactactancatgtatcaacacagaccaggcagcctactaagtgctcatttacnggcagtccgaccgggaactccggggtcccctgagcgattcgagtgcgaggcgggtcgtcgggacagtactttcaactctcaccatcagcacgtccacgcaaacctgaaagataggtggactagtttaattactgtacaagtacaaattattaagtacgtactaccctcgacctaccgttacggaccgaacgggaaccaacggacctaaggaacgtaaataaaaccgacgtaggtcggactacgg

SEQ ID NO: 417891 - DNA, 716 bp, Homo sapiens
  misc_feature: GZ8MTXP02J1DAW.44.67.G01.1.454.CMB.2.raw
  modified_base (300)..(300): a, c, t, g, unknown or other
  modified_base (331)..(331): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataatggaatatgcagtgggtccnccaggctccaggcgaggggctggaggtgggnggcgaggtgtgtcatttcagtggagaaatcaagtcgtacgggtgacgttccggttggacggggtccgagtttccacccgtactcctaccgaagaacgaacaaacttacccggaagaaaccaacgtagttcgtacttaccttacaaaactacggaaacacgaccgttaggaacgacccgttacgaacgggtaaccgaccgggtacccgttacggtttaattttttacgggtacggtaccggtaacgggttaaaccttaacgtttaccgttacggttttaaacccgttaaaaacgtttaacccggggttttaaccttaaaccggtttacccggggtaacccggttaccccgggttaccggggggtaccccggttaaaaccccggggg

SEQ ID NO: 417892 - DNA, 547 bp, Homo sapiens
  misc_feature: GZ8MTXP02HYPEI.44.67.G01.1.454.CMB.2.raw
  modified_base (302)..(302): a, c, t, g, unknown or other
  modified_base (356)..(356): a, c, t, g, unknown or other
tcagacagtatatacacgaccggtgctcgatttagagtatacatattgggtttgggggagctacaaaaaggcaggcaggggcagcaagatggtgttgcagacccaggtcttcatttctctgttgctctggatctctggtgcctacgggacatcgtgctgacccagtctccaaagtccctggctgtgtctctgggcgagagggccaccatcaactgcaagtccagccagagtatttatacacctccaacaatcaccactactatcatgtatcaacacagaccaggcagcctcctaagttgctntatttactgggcatcgaccgggtaactccggggtccctgagcgattcagtggcnggcgggtctgggactagatttcacttctcaccatcagcagcctgacaacctgaacgatgtgctagtttatacgtgtcagactaaatattagtacggtacctccgtacgacctaccgttcggaccgtaaagggacctaccgacgtaggaaacgtaactttaaaaccggactaggtacggtcgttacgaaccc

SEQ ID NO: 417893 - DNA, 574 bp, Homo sapiens
  misc_feature: GZ8MTXP02I6C8S.44.67.G01.1.454.CMB.2.raw
  modified_base (286)..(286): a, c, t, g, unknown or other
  modified_base (300)..(300): a, c, t, g, unknown or other
  modified_base (434)..(434): a, c, t, g, unknown or other
  modified_base (491)..(491): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagcgtggttctccttgttggacttttaaaggtgtccagtgtgaggtgcggctgatggagtctggaggaggcttagtccaggccgtggggggtcccagagactctcctgtgcagcctcgtgggcctcaccgtcagcagcaacncatgagttcggccncaggctcgagggagggctggagtcgggctcagtctatttagtactgggttactatttcaacattaccacgcagtactccgtagaacgggtccattccacattccacgaggacaagttacagtactacggtttancttacaaatcgaaacaccgagacgacggacgaccgtacgaccggtctactattcggngagacgacgacgacggcggcgtacgtacggtagttagttaagttacgtttacgttacgtacgtcggtacggtaccggtaccgg

SEQ ID NO: 417894 - DNA, 564 bp, Homo sapiens
  misc_feature: GZ8MTXP02H8FUX.44.67.G01.1.454.CMB.2.raw
  modified_base (272)..(272): a, c, t, g, unknown or other
  modified_base (308)..(308): a, c, t, g, unknown or other
  modified_base (336)..(336): a, c, t, g, unknown or other
  modified_base (391)..(391): a, c, t, g, unknown or other
tcagacagtatatacacgaccggtgctcgatttagagtatacatattgggtttggggagctacaacaggcaggcaggggcagcaagatggtgttgcagacccaggtcttcatttctctgttgctctggatctctggtgcctacggggacatcgtgctgaccagtctcaaagtccctggctgtgtctctggggcagagggccaccgatcaactgcaagtccagccagagttatttatacacctcaacatcacctatactatcatggtatcaanacagaccagggcagcctctaagtgctctatttacgnggcagtaccgaccggtacgtccggcccngacgcgtatcgagtcggcagggtcggtcgtaggactagtacttcacctcacacancgagacacgtcctcgacctaacgtagaacgtgtcgtaggtacttagtttaatacgtgtacgacgtactaattaattagtacgtacgtacgtacgtacgtaccgtaccgtaccgtaacggacgaacgtacgtaacgtaacgtaacgtaaacgtaacgtacggtacgtacgtacg

SEQ ID NO: 417895 - DNA, 593 bp, Homo sapiens
  misc_feature: GZ8MTXP02FKGAN.44.67.G01.1.454.CMB.2.raw
  modified_base (238)..(238): a, c, t, g, unknown or other
  modified_base (266)..(266): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgagagggccaccatcaactgcaagtccagccagagtatttanacacctaccaacaatcaccactacttancatgtatacaacacagaccaggcagccctactaagttgctctatttacgtgggactacgtccggaacccgggtaacgtcccgggggtacccccctggacgtccgtaattcgaaggtcgggtccgagggtccggggtcgtacggggaactaggtactttccactcctactaccatcaagcacgcctcgaccaaaccgtagaaacgtagtggtggtacttagtttacttactgtacagtactaattactagtacggtactcctacgcctaccgtacgaccgtaacggacacgacgaaggaacgaacttaacgaacgtgtacggactacg

SEQ ID NO: 417896 - DNA, 552 bp, Homo sapiens
  misc_feature: GZ8MTXP02FJVYH.44.67.G01.1.454.CMB.2.raw
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggcctccgaggggaaggggctggagtgggtctcgagtcatttatactggtgatttcacatactacgcagactccgtgaaggccgattcaccatctccagggacaattccaggaacacggtttatcttacaaatgaaacaacctgagagggacgacgacacggccgtactattacgtgtagcgagacaacggtcggacgcgtacggagtggttaatttattacgtttgacgtttcgtcggggctaacgggg

SEQ ID NO: 417897 - DNA, 588 bp, Homo sapiens
  misc_feature: GZ8MTXP02FSLHK.44.67.G01.1.454.CMB.2.raw
  modified_base (237)..(237): a, c, t, g, unknown or other
  modified_base (264)..(264): a, c, t, g, unknown or other
  modified_base (315)..(315): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactacttancatgtatcaacacagaccagggcagccctacctaagttgctctatttacgngggcacgtccgacccgggaacgtcccggggtcccctgacgcgattcgagtggcaggcgggtcgtggggacaggtatttcacttctccacatcagcacgcctgaccaacctgaaacgtagtggtggtactagtttacttacgtgtacagactaattatagtacggaccttccgtcggacctacccgttaccggacccgaaaacgggggtacccaacggtaacgtaacgggaaacgtaacgtttaaaaacccggaacgttcggtacggcttacgg

SEQ ID NO: 417898 - DNA, 604 bp, Homo sapiens
  misc_feature: GZ8MTXP02I7BRA.44.67.G01.1.454.CMB.2.raw
  modified_base (460)..(460): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacacctcaacaatcaccactactatcatgtatcaacacacgaccagggcacgcctacctaagttcgctactatttacgtggcacgtccggaccccgggaagtcccggggtaccccctgacgtcgactttcgaggttcggcgacggtcggggtcgtaggggaccaggttactttccgaacttctaccaacccatcaagcacgtcctagaccaaacctgaaagtntggtacggcttaagtttactaaccgtgtacacgtactaaattacgttaagacggtccctccgtaccgtacctacccgttcggaaccgaagggaacccaggtacctaagggaactaacgttaaaaccgacgttggcggtactacg

SEQ ID NO: 417899 - DNA, 757 bp, Homo sapiens
  misc_feature: GZ8MTXP02HHXP3.44.67.G01.1.454.CMB.2.raw
  modified_base (282)..(282): a, c, t, g, unknown or other
  modified_base (291)..(291): a, c, t, g, unknown or other
  modified_base (296)..(296): a, c, t, g, unknown or other
  modified_base (321)..(321): a, c, t, g, unknown or other
  modified_base (326)..(326): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcacttgatatgatngcagtggcncagcnccgaggcgaggggctggaggtgggnggcgnggtgtgtctatttcagtggaagtaatcgtaaagtcgtacgggtgtacgtttccggttagggacgggtcccgtattacccgaaccctattcccgtacccgtaacgaacgtaacctaaaccgtttacccggaaacgaaaccaacgtaacggttacgttaccctttacctttaaccgtaaaagttacgtaaaacacggtacccgttaggaaaccgaaccccgttaccggaaaccgggtaaccggtaacccgggttcccggttttaagggtttaacggtttttttacgggtcggttaccggttaaacggttaacctttacgtttaccgtttaacgttttaaccccgttaaaaacggtttcccggtttaccgttaaccgtttacccgggtaacccggttcccgggttaccgggggtaccccggtaaaccccggggg

SEQ ID NO: 417900 - DNA, 581 bp, Homo sapiens
  misc_feature: GZ8MTXP02FOEKJ.44.67.G01.1.454.CMB.2.raw
  modified_base (372)..(372): a, c, t, g, unknown or other
  modified_base (422)..(422): a, c, t, g, unknown or other
  modified_base (437)..(437): a, c, t, g, unknown or other
  modified_base (442)..(442): a, c, t, g, unknown or other
  modified_base (489)..(489): a, c, t, g, unknown or other
  modified_base (520)..(520): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaggtgtccagtgtgaggtgcgggctgatggagtcgtggaggaggcttagtccagccgtgggggtcccagagactctcctgtgcagcctcgtgggctccaccgtcagcagcaactacatggagttcgggtcccgccgagggcctaccggaggggaaggggctggggagtcggggtctcgagttctaatttatacgtgggtntatttcactatacctacgcagctccgagaacggcatcacatcacgagganatccagactagttanactanaaatgaaacactgagacggacacgacgacggccgtactagttaccgngtgacgacgacaacggtcggacgcgtacggngtttaggttaagtttacgtttacggttacgtcgtttacggtcgggggacctaacccggggg

SEQ ID NO: 417901 - DNA, 654 bp, Homo sapiens
  misc_feature: GZ8MTXP02FJEC4.44.67.G01.1.454.CMB.2.raw
  modified_base (238)..(238): a, c, t, g, unknown or other
  modified_base (263)..(263): a, c, t, g, unknown or other
  modified_base (315)..(315): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgagagggccaccatcaactgcaagtccagccagagtatttanacactccaacaatcacactacttancatgtatacaacacagaccagggcagccctactaagttgactctatttacgngggcagtaccggacccggggaaacgttcccggggtccccctggacgcggtacttacgagtcggtcgacggtcggggtcgtggggactagtactttcactctccaacgtatcaagcacgccctagccctaaaaccgtggtaaagagttcggtaggtacgttaacgtttttaataacgttcgtacctaaggaacttaaagttaatttaaacgttacggaaccctttcctacccgtaccgttaaccccgttacgggaacccgtaaaacgggggacctaacccggaacggttaaggaacggttaaaacttaaaaacggaccgtttacgggtacgtaccgtacg

SEQ ID NO: 417902 - DNA, 663 bp, Homo sapiens
  misc_feature: GZ8MTXP02JZGTH.44.67.G01.1.454.CMB.2.raw
  modified_base (242)..(242): a, c, t, g, unknown or other
  modified_base (267)..(267): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgaggacgggccaccatcaactgacaagtccagccagtagtatttanacacctacaacatcaccactactancatgtatacaacacagaccagggcacgtccctactaagttgctactactttacgtgggcacgtaccggaacccggggtacgtcccggggtacccctggacgtcgtacttcgaggttcggcgtacgggtccgggtacgtggggacctaggttactttccgaccgtcctaccacctagtcagccgacgcctacggacctaaccgtagaaacgtagttcggtacggtacgttaacggtttaacttacgtcgtaccgtagtaactaaagttaacgttagtacggtaccttacccgtaccgtacctaacccggttacggaaccgaaacgggtaccaaccggtaacggtaacgggaaacgttaaacgttaaaaccgtacggtacggttacggaccgttaccg

SEQ ID NO: 417903 - DNA, 650 bp, Homo sapiens
  misc_feature: GZ8MTXP02GOU8D.44.67.G01.1.454.CMB.2.raw
  modified_base (286)..(286): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctcgtgggcgaggacgggccaccatcaactgacaagtccagccagtagttatttacacacctacaacaatcaccactacttatcatggtatcaacacanaccgagggcacgcctactaagttcgctcatttacgtggctagtccgaccgggacgtccggggtcccctgacgcgtatcgagtcggcgagggcgggtcgtaggggactaggtacttacaccttcgtacctaccgtacttaccgagtaccacgtaccgttacggacctaaacccgtaggtaaacgaaggttcggtacggtaccgttaggttttaacttaaccgttacgtacgtacggtaactaaatttacgttaagtaacggtacttaccgtaccgtacctacccgtttaccggaaccgtaacggtaccgacgtaccgtaaggtaacgtaaacgttaaacgaacgttcggtacggtacgtaaccgg

SEQ ID NO: 417904 - DNA, 633 bp, Homo sapiens
  misc_feature: GZ8MTXP02H6FPK.44.67.G01.1.454.CMB.2.raw
  modified_base (481)..(481): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggcctccaccgtcagcagaccaactacatgagttcggccgccaggctccgaaggggaacggggctagggagtcggggtctcgagtctagtttactacgtcggtagtatttcgaactaatacctacgtcagtactccggtagaacggccgacttcaaccgtataccgtaccgaagggaaccaaagttacccgaaggtaaacctacggtttaatcctaanaaaatcgaaacaaccgtagaacgaggaccgaacgaccgacgggtaccctattactacgtgtcggacgtaagaacgtacggcggacgtccgtagggtagttagtttaattacgtttacgttcgtaaccgttcggtcggggaacccgtacgggg

SEQ ID NO: 417905 - DNA, 619 bp, Homo sapiens
  misc_feature: GZ8MTXP02HYEA8.44.67.G01.1.454.CMB.2.raw
  modified_base (319)..(319): a, c, t, g, unknown or other
tcagacagtatatacacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgaggaggccaccatcaactgcaagtccagccagagttatttatacacctaccaacaatcaacccactacttatcatggtatacaacacagaccagggcacgcctactaagtgctctatttacgnggcagtaccggacccgggtaacgtccggggtccccctgacgcgtattcaggttgcgaggcggtcgtgggaccagtactttcactctacaccactcagcacgcctcgaccaacctaggaaagtagtggtacgtacgtagtttaacgttacgtaggtaccacggtaactaaaagttagtttaacgtacgggtaacccttccgtaccgtacccgtacccgttaccgggaacccgaaacgggaccgtaacggaccgtaaggaaacgtaaacgttaaaacgacgtacggtacggtacgtaacccg

SEQ ID NO: 417906 - DNA, 651 bp, Homo sapiens
  misc_feature: GZ8MTXP02GADXS.44.67.G01.1.454.CMB.2.raw
  modified_base (177)..(177): a, c, t, g, unknown or other
  modified_base (301)..(301): a, c, t, g, unknown or other
  modified_base (517)..(517): a, c, t, g, unknown or other
  modified_base (547)..(547): a, c, t, g, unknown or other
tcagacagtatatacacgaccggtgctcgatttagagtatacatattgggtttggggggagaggagcccagcactgggattccgaggtgtttccattcggtgatcagcactgaacacagaggactcaccatggagttttggctgagctgggttctccttgttggacttttaaaaggngtccagtgtgaggtgcggctgatggagtcgtggaggaggcttagtccagccgtgggggtcccagagactctcctggtcgcacggtcctcgtgggcctcacccggtcacgcacgctaaacactanggaggtttcggccggccaggtcctacgaggggaacgggtcgtggggagttgggtctacgtacggttactaagtttacgtagttggtacgttacttcgactaagttactagctacgtacgtcgtagacgggcctattaccactgtccacggaacggtactaacgttacccgagggtaacttacggttactactaactaaaacgcgaaactaaaccgngacgacggaccgaacgtcgaccggtacgtnttaacgtcgtagacgacgtacgacgtacggccgcggtacgttcggttagttacggttaagtttaacgtttcgttacgtaccgtcggtacgggtaaccgaccggg

SEQ ID NO: 417907 - DNA, 595 bp, Homo sapiens
  misc_feature: GZ8MTXP01B0FBE.45.67.G01.1.454.CMB.2.raw
  modified_base (257)..(257): a, c, t, g, unknown or other
  modified_base (272)..(272): a, c, t, g, unknown or other
  modified_base (541)..(541): a, c, t, g, unknown or other
tcagacgcgatcgacacgaccggtgctcgatttagagtatacatattgggtttggggggaagaggaagactgacggtcctcccaggagttcaggtgctgggcaccttgggcacgggggaggcgtggtccaggccgggggggtctctgagactctcctgcgctgcctctggattcaccttcagtgcttatgctctccactgggtccgccaggggccaggcaagggtctgggagtggggtgggagccgtctacaaaggntgggagaataaaacntatttcgcagactccgtgtggcgccgattcaccatctccaagaaacaatcccgggaacaccctacatctccacatgaaactccctagacgaccggaggacccacggcttgtttattctgtgccagaggtcgaaggagtgggcgtggggcgaactcaactccctacgaatacctactactacagtcgacgccgtggggacgaaacgggtccgtcggtcgccgtctcctcacgtcttccgaccgtacgggccaacgtcgttccttccccgnggcccgtcccttcgccttccgaaggcgccaccgtcgttcgggggccaacgcggg

SEQ ID NO: 417908 - DNA, 597 bp, Homo sapiens
  misc_feature: GZ8MTXP01BA0S5.45.67.G01.1.454.CMB.2.raw
  modified_base (374)..(374): a, c, t, g, unknown or other
  modified_base (381)..(381): a, c, t, g, unknown or other
  modified_base (506)..(506): a, c, t, g, unknown or other
  modified_base (522)..(522): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaagtggtggaggtcggggggaggcggtggtccgagggccgggggggtctcgtgagactctcctgcgctgcctctggattccacctcagtgcttatgctctccacgtcgggtcccgccgagggggccaggcgaaggggtcgtgggaggtgggggtgggacgccgtcgtacgaaaggntaggaanaaataaacaattacttcgactagactccggtgtcggcgcgtattcaccatcctaccaagaaaccacgtacccgggaaccacccacactctaccaactatacgaaacctccgtagacgacgagacncgtcttagttacttcngtcgccgaggttacggtacggaaggttgttgggcggtcggggacaacgtacacttcccgtaacgttaactaaccg

SEQ ID NO: 417909 - DNA, 549 bp, Homo sapiens
  misc_feature: GZ8MTXP01D6ICL.45.67.G01.1.454.CMB.2.raw
  modified_base (244)..(244): a, c, t, g, unknown or other
  modified_base (252)..(252): a, c, t, g, unknown or other
  modified_base (265)..(265): a, c, t, g, unknown or other
tcagacgcgatcgacacgaccggtgctcgatttagagtatacatattgggtttgggggaagaggaagactgacggtcctcccaggagttcaggtgctgggcaccttgggcacgggggaggcgtggtccaggccgggggggtctctgagactctcctgcgctgcctctggattcaccttcagtgcttatgctctccactgggtccgccaggggccaggcaagggtctggagtgggtggagccgtntcaaaggntggagataaaacntattcgcagactccgtgtggcgccgattcaccatctccagaaacaatccccgggaacaccctacatctccacatgaaatccctgagaccggagaccacggctgttattctgtgccagaggtcgaaggatgggcgtggggcgaactcaatccctacgaatactactactacatgacgctggggcgaaagggcctcggtacgccgtctcctcagctccaccagggcccaatcgctccccttggccgcccttgccttccaaggacgcactcgttggggcaacgcggg

SEQ ID NO: 417910 - DNA, 673 bp, Homo sapiens
  misc_feature: GZ8MTXP01CSVG0.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatgggtggaggtcggggggaggcggtgggtccgagggccgggggggtctcgtgagactctcctgcgctgcctctggacttcacctcagtgcttatgcctctccacgtcggggtcccgccgagggggccagggcgaagggggtctgggaggtgggggtgggacgccggtctacgaaagggatagggaagtaataaaacgattaacgtttcgactaacggtaccgttcccggtggtcgggcccgtacccgtactttaccaccctactcctacccaaacgaaaacctaaccgtaccccgggaaacccacccctacactcctacccaactataacgaaactaccccgtagaacggaccggacggaccgacggtccttgtttacttctggtcgccgaaggacggttacggaaggttacggttcgggcgggtcggggacctaacgtacgtaaccttaccccgtaacgttaactttaaccg

SEQ ID NO: 417911 - DNA, 563 bp, Homo sapiens
  misc_feature: GZ8MTXP01A1NHM.45.67.G01.1.454.CMB.2.raw
  modified_base (285)..(285): a, c, t, g, unknown or other
  modified_base (355)..(355): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcggggggaggcgtggtccaggccggggggtctctgagactctcctgcgctgcctctggattcacctcagtgcttangctctccactgggtccgccagggggccaggcaaggggtctgggaggtggggtggagccgtctcgaaaggntggagataaaacatatttcgcagactccgtgtggcgcgattcacatctaccagaaacactacccgggaacacccctacactctaccacgatagaaactccccgtagacgaccggaggacacggtcttgtttacttcgtgtcgccaggacggtacgaaggagttgggcggtggggaccgtaactcgaacttcccgtaaccgaataaccc

SEQ ID NO: 417912 - DNA, 666 bp, Homo sapiens
  misc_feature: GZ8MTXP01C2LBX.45.67.G01.1.454.CMB.2.raw
  modified_base (263)..(263): a, c, t, g, unknown or other
  modified_base (437)..(437): a, c, t, g, unknown or other
  modified_base (600)..(600): a, c, t, g, unknown or other
tcagacgcgatcgacacgaccggtgctcgatttagagtatacatattgggtttggggggaagaggaagactgacggtcctcccaggagttcaggtgctgggcaccttgggcacggggggaggcgtggtccaggccggggggggtctctgagactctcctgcgctgcctctggattcaccttcagtgcttatgctctccactgggtccgccgaggggccaggcaaggggtctgggaggtggggtgggagccgtctacgaaaggntagggaagtaataaaacgattatttcgacagactccggtgtggcgccgattcaccatcctaccaagaaacaacgtaccccgggaacacccctacactccaccacactagaaactcctagacgacggagaccacggtcttgtttacttcgtgtcgccgaggagggtacggaaggngtgggcggtggggacaacgtcaactcccgtacgaatactactaactacagtacggaccgacgggtcggggacggaaacggggtcccgttaccgggtccgtaccgtcctaccgtcacgtccttcccaaccggacggccctaacgtcccggttcccttcccccgnggtcccgcccttcgttcccttaccgaacggcgccgtaccggtcggttacggggccaaccggccggg

SEQ ID NO: 417913 - DNA, 881 bp, Homo sapiens
  misc_feature: GZ8MTXP01AT5OQ.45.67.G01.1.454.CMB.2.raw
  modified_base (363)..(363): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccgaggtccggggggtctcgtgagactctcctgcgctgcctctggattcacctcagtgcttatgctctccacgtcgggtcccgccgagggggcccaggcgaagggtctgggagtggggtggacgcgtctacgaaacggntagggaagtataaaacgtacttaagtttccgacgtagtaccctcccgggttaggtcgggacccgtcccgggtaactttccgaaccccgtaacttacccgttacccgaaacggttaaaaaccccgaaaacccgggttaacccccccgggggaaaacccctaaacccccccgtttaaaacccaaccgtttaccccgtttaaacccccgaaaccgtaaacgtttaaaccggggtaaaaaaacccctttccccccccggttaaaggggtaaaccccggggtaaaccccgggggtaacgggaaacccccggtaacccggggggtttacctttttacggggttttttaaaccgttttcccggttaaggggttccgttaccccgggaaaggggttaacggggttacccgggaaaagggggttaaccggttgggggttccggggtttaacgggggggaccctaaaacccgggtttaccaaaccccgttccccgggttaaaccccgttaaacgttttaaaacccccg

SEQ ID NO: 417914 - DNA, 732 bp, Homo sapiens
  misc_feature: GZ8MTXP01EKKPD.45.67.G01.1.454.CMB.2.raw
  modified_base (262)..(262): a, c, t, g, unknown or other
  modified_base (278)..(278): a, c, t, g, unknown or other
tcagacgcgatcgacacgaccggtgctcgatttagagtatacatattgggtttggggggaagaggaagactgacggtcctcccaggagttcaggtgctgggcaccttgggcacggggggaggcgtggtccaggccggggggggtctctgagactctcctgcgctgcctctggattcaccttcagtgcttatgctctccacgtgggtcccgcgaggggccaggcaagggtctgggaggtgggtgggagccgtctacgaaaggntggaagaataaaacgnttatttcgcagactcgtgtggcgcgattcacatctaccaagaacaacgtacccggaacaccctacatcctaccactatagaaactcctagacgaccggagaccgacggtcttagtttacttcgtagtcgccgagggtacgggtacggaagggtagtcggggtacgggtacggggaccgtaactacgtaaccgtccctaaccgaaattaacctaactaactaacgacggttacggaccgtacgggttacggggacggaaaacggggtcccgttccgggtcccgtccggttccctccgttacgaccgtcccgttaacccgaaccggtaaccgggtcccctaacggttcccggtttccccgttcccccggttggtccccgtcccgttcgcccgttaccggaacggacccgtcccgtacccgggttcggggaccgggggtaaccaacggccccggggg

SEQ ID NO: 417915 - DNA, 645 bp, Homo sapiens
  misc_feature: GZ8MTXP01EWVOT.45.67.G01.1.454.CMB.2.raw
  modified_base (263)..(263): a, c, t, g, unknown or other
  modified_base (279)..(279): a, c, t, g, unknown or other
  modified_base (377)..(377): a, c, t, g, unknown or other
  modified_base (395)..(395): a, c, t, g, unknown or other
tcagacgcgatcgacacgaccggtgctcgatttagagtatacatattgggtttggggggaagaggaagactgacggtcctcccaggagttcaggtgctgggcaccttgggcacggggggaggcgtggtccaggcccgggggggtctctgagactctcctgcgctgcctctggattcaccttcagtgcttatgctctccactgggtccgccgaggggccaggcaaggggtctgggagtggggtgggagccgtctacgaaaaggntgggaagaataaaacnttatttcgcagactccgtgtggcgcgattcacatctcagaacaatcccgggaacaccctacatctccacatagaaatccctgacgacggagacacggntgtttattctgtgccagnggtacgaggagtgggcggtggggcgaacgtcgaaactccctacgaataactactactacatcggacgacgtgggacgaaacggggtaccgtcggtcgccgtctcctacgacgtccgttcccgaaccgaaccgggccccgtaacgtcccgggttccctttccccccgttgggtccccgccccgttcgcccgttcccgaacgggaaccgtccgtccccgttcggttccggggggtccaaccggtcccggggg

SEQ ID NO: 417916 - DNA, 666 bp, Homo sapiens
  misc_feature: GZ8MTXP01CXP66.45.67.G01.1.454.CMB.2.raw
  modified_base (365)..(365): a, c, t, g, unknown or other
  modified_base (377)..(377): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgacaaagtggtggaggtcggggggagcggtggtccgagggccggggggtctcgtgagactctccgtgcgctgcctcgtggacttcacctcagtcgtcttatcgctcctccacgtcggtcccgccgaggggccaggcgaagggtctgggaggtgggggtggacgcccggtntacgaaaagggngtaggaagtaaactaaaacgtaattacgtttcgactacgtaccgttccgggtgtacggggccaccgtacttaccaacctactacctaacccgaaacgaaaaccgtaaccgtaccccggaaacctaaccctaacactaccgtaccaacgtatacgaaacctcccgagacggaccggtagaacctacggtcttagtttcttgtgtcgccgtaaggacggtacggaaaggttgttcgggttacggtcggggaacctaacgtcgaacttccccgtaacgttaaacttaacccg

SEQ ID NO: 417917 - DNA, 859 bp, Homo sapiens
  misc_feature: GZ8MTXP01AV42R.45.67.G01.1.454.CMB.2.raw
  modified_base (162)..(162): a, c, t, g, unknown or other
  modified_base (365)..(365): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttccncgtcgctcttttaagaggtgtccaatgtcaggtgcaaatggtggagtcgggggagcgtggtccaggccgggggtctctgagactctcctgcgctgcctctggattcacctcagtgcttatcgctctccacgtcgggtcccgccgagggggccaggcgaaggggtctgggaggtgggggtgggagccgtcgtacgaaaacgggngtagggaagtaaataaaaaacctaagtttaaacgttttccggacctaaacggtacccgtttcccgggtaggggtttacggggcccgtaccccgggtaactttacccgaaaccccgtaacgttacccttaaccccgaaaaccgggtaaaaacccgtaaaacccggtttaaccccccgggggaaaaccctaaacccccccgttaaaccaaaccgttccccgttaaacccccgaaaccgtaaacttaaaccggtaaaacccgttaccccccggttaagggaaacccgggtaaccccgggggtaacgggaaacccgtaacccgggggttacctttacggttttttaaacgtttccgttaacggttacgaccccggtaagggttacggggttaaccgggaaaaggggttcggtttacgggggccgggttaaggggggaaccccgtaaacggttccctaaaaccgttcccccgttaaccggttaaaaccgtttaaccccg

SEQ ID NO: 417918 - DNA, 742 bp, Homo sapiens
  misc_feature: GZ8MTXP01AOSAV.45.67.G01.1.454.CMB.2.raw
  modified_base (268)..(268): a, c, t, g, unknown or other
tcagacgcgatcgacacgaccggtgctcgatttagagtatacatattgggtttgggggggaagaggaagactgacggtcctcccaggagttcaggtgctgggcaccttgggcacggggggaggcgtggtccaggccggggggggtctctgagactctcctgcgctgcctctggattcaccttcagtgcttatgctctccacgtcgggtccgccgaggggccagggcaaggggtctgggaggtggggtgggagccgtctacgaaaaggntgggaagaataaaaacattatttcgacagtactccggtggtggccgccgattccacctatcctaccaagaaaaccaacgtaccccgggaaaccacccctactactcctaccacatacgaaactccgtagacgaccggaggaccctacggtcttgtttacttcgtcgtcgccgaggtaggtacggaagggtagtcggggcgggtacggggaccgtaaactccgtaacgtcccctaccgaaattaccgtaactaactacgtacgtcgggaccggtccggttagggggaaccggtaaaacggggtcccgttccggggtcccgtcccggttcctcccgtacgaacgttcccgttaacccgaacccgaacggggtcccctaacgttcccggttccccgttcccccgttcggtcccgtccccgttcgcccgttccgaaccgggtcaaccgcccgttacggcggggtccaaccgcccgggg

SEQ ID NO: 417919 - DNA, 681 bp, Homo sapiens
  misc_feature: GZ8MTXP01CRVIT.45.67.G01.1.454.CMB.2.raw
  modified_base (280)..(280): a, c, t, g, unknown or other
  modified_base (296)..(296): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgcttcttttaagaggtgtccaatgtcaggtgacaaagtgggtgggaggtcggggggaggcggtgggtccgagggccgggggggtctcgtgagactctcctgcgctgcctctggnttcactcagtgcttangctcctccacgtcgggtccgccgagggggccaggcgaagggtcgtgggaggtgggggtgggacgtcccggtactacgaaaacgggtgtaggaagtaaataaaaccaattactttcgactaagtaccgtcccggtggtcgggccgtacccgtacttaccacctactcctaccgaaacgaaaccaaccgtaccccgggaaacctacccctaacactcctacccactaacgtacgaaacctcccgtaggaaccggaccgggaaggtaccgacggtcttacggtttacttcgtgttcgccgtaaggttacgggtacggaagggttaggttcgggacgggtaacgggggacctaaccgtaccgaccttaccccgtaacgaacgttaaccc

SEQ ID NO: 417920 - DNA, 603 bp, Homo sapiens
  misc_feature: GZ8MTXP01D4596.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggagcgtggtccaggccggggggtctctgagactctcctgcgccgctctggattcaccttcagtgcttatgctctccactgggtccgccgaggggccaggcaagggtctggagtgggtgggagccgtctacgaaaggctgggagaataaaacataattcgcagactccgtgtcggcgccgattcaccatctcaagaaacaactacccgggaacaccctacactacctaccacactacgaaactcccctagaacgaccggagaccgtacgggccttggtttaacttcctgtcgtaccgaggaggttcggaaagggaggttcgggcggttacgggggaaccgtaaaccgtccgtaaacgtccccgttaccggtaacgttaaccgttaaaccc

SEQ ID NO: 417921 - DNA, 696 bp, Homo sapiens
  misc_feature: GZ8MTXP01DGADO.45.67.G01.1.454.CMB.2.raw
  modified_base (272)..(272): a, c, t, g, unknown or other
  modified_base (384)..(384): a, c, t, g, unknown or other
  modified_base (584)..(584): a, c, t, g, unknown or other
  modified_base (670)..(670): a, c, t, g, unknown or other
tcagacgcgatcgacacgaccggtgctcgatttagagtatacatattgggtttgggggggaagaggaagactgacggtcctcccaggagttcaggtgctgggcaccttgggcacggggggaggcgtggtccaggccggggggggtctctgagactctcctgcgctgcctctggattcaccttcagtgcttatgccttctccacgtgggtcccgccgaggggccagggcgaaaggggtctgggaggtggggtgggacgccgtctacgaaaggntaggaagaataaaacattactttcgctagtactccggtggtcggccgccgtattccaacctactcctaccaagaaaccaacgtaccccgggaacacccctacactctaccanatagaactccgagacggacggagaccagtaggtcttgtttacttcgtgtcgacctagggacgggtacggaaaggtgtggggacgggtggggactaatccgactcccgtaacgtaactactactaacgacagtcggaccgtaccggtacggggggaaccgaaacggggtcccttcggggtcccgtcccgttctcccgtacncggtcccttacccgaccgacgggcccctaacgttcccggttacccttccccgtcgggcccttcccgttgcccgtaacgcgtaaccnccgaccgttcgggtcggccgaaccgg

SEQ ID NO: 417922 - DNA, 958 bp, Homo sapiens
  misc_feature: GZ8MTXP01BXLKS.45.67.G01.1.454.CMB.2.raw
  modified_base (279)..(279): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaagtggtggaggtcgggggaggcgtggtccgaggccggggggtctcgtgagctctcctgcgctgctctggatcactcagtncttatgctcctccacgtcgggtcccgccgagggggccccaaggggccgaaagggggttccgtaggggagggttcggggggtgggggaacgtcccggttacgttaccgaaaaacggggtacgttaggggaaagaaacgttaaaaaaaccttaagttaactttttcccgggaaacctaaacgggttaaacccgttacccccgggtttgggggttaccgggggacccggtacccccgggtaacgtttttcccgaaaccccgtaacttaccccttaaccccgaaacggtaaaaaaaccccgtaaaacccggttacccccccgggggaaaacccttaacccccccttaaaaccctaaccttaccccgtttaacccccgaaacccgtaaacgttttaaaccggggaaaaccctttacccccggtttaacggggaaacccggggtaaaccccgggggtaaaccggggaaacccggtaacccgggggttaccctttttaaccggggttttttaaaccgttttttcccgtaacggggtttaccggaaccccggtaaagggggttcggggttaaacccggggtaaaggggttacggttcgggggacccggggtttaaggggggaaccccgtaaccgttacccgtaaaaccgttacccccgtaaacccgggttaaactttaaaacccccg

SEQ ID NO: 417923 - DNA, 612 bp, Homo sapiens
  misc_feature: GZ8MTXP01EC87T.45.67.G01.1.454.CMB.2.raw
  modified_base (368)..(368): a, c, t, g, unknown or other
  modified_base (529)..(529): a, c, t, g, unknown or other
  modified_base (544)..(544): a, c, t, g, unknown or other
  modified_base (548)..(548): a, c, t, g, unknown or other
  modified_base (591)..(591): a, c, t, g, unknown or other
tcagacgcgatcgacacgaccggtgctcgatttagagtatacatattgggtttgggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgacaaagtggtggaggtcggggggaggcgtggtccgaggccgggggggtctcgtgagactctcctgcgctgcctctggatcacctcagtgcttatgctctcacgtgggtccgcgaggggccaggcgaaggggtctgggaggtcgggggtgggacgccgtactacgaaaaggngtaggaagtaaataaaaacaattaatttcgacaagactaccgtgtcgggacgaccgtaattccaaccagtcctaccaaacggaaaaccaacggtaccccggaaaccaccctaacacgtacctaccaacataacgaaactccccgtagacgacggagaaccncggtcttagttactngtcncgaggttacgaggaagttgcgggacggtaagggacaaccgttnaacttccctaacgaactaacc

SEQ ID NO: 417924 - DNA, 759 bp, Homo sapiens
  misc_feature: GZ8MTXP01EYIYJ.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggaggcgtggtccgaggccgggggggtctctggagactctcctgcgctgcctctggattccactcagtgcttatcgtctctccacgtcgggtcccgcgtacgggggcccaggcgaagggtcgtgggtagggtgggggtgggacgcccggttacgtacgaaacgggtagtaggaagtaaactaaaacctagtttaacgtttcggactaacggaccgtttccgggtcggttcgggaccgtacccgtaacttccacctaacgtccctaacccgaaacggttaaaacccgaaccgttaaccccccggggaaacctaaccctaccaactttacccctaccaaacctaacgtaaccggtaaaacccttccccgggaacggaaaccggacccgggtaagtacccggaaccggttcctttagttttaacgtttcgaacggttcgacccggtaaagggttcgggttaaacggaacgggttagttcgggggacccgtaagggggtacctaaccgtaaccgtaaccgttaccccgtaacgttaaaccgttaaccg

SEQ ID NO: 417925 - DNA, 379 bp, Homo sapiens
  misc_feature: GZ8MTXP02HWQVN.45.67.G01.1.454.CMB.2.raw
  modified_base (373)..(379): a, c, t, g, unknown or other
tcagacgcgatcgacacgaccggtgctcgatttagagtatacatattgggtttggggaggtgtgtcacaagatttgggctctgggcaccgtgggcacgggggaggtgtgtcacaagatttgggctctgggcaccgtgggcatgtgtgagttgtgtcaccaagtggggcgaactcaatccctccgaatactactactacatggacgcctggggcaaagggacctcggtcgccgtctcctcagcttccaccaagggcccatcggtctcccctggccgccctgctccaggagcacctctggggcacagcggccctgggctgcctggtcaaggctacttcctcgatcgcgtctgagcgggcctggcaggcgcatagnnnnnnn

SEQ ID NO: 417926 - DNA, 373 bp, Homo sapiens
  misc_feature: GZ8MTXP02IN3VS.45.67.G01.1.454.CMB.2.raw
  modified_base (373)..(373): a, c, t, g, unknown or other
tcagacgcgatcgacacgaccggtgctcgatttagagtatacatattgggtttgggggaggtgtgtcacaagatttgggctctgggcaccgtgggcacgggggaggtgtgtcacaagatttgggctctgggcaccgtgggcatgtgtgagttgtgtcaccaagtggggcgaactcaatccctccgaatactactactacatggacgcctggggcaaagggacctcggtcgccgtctcctcagcttccaccaagggcccatcggtctcccctggcgccctgctccaggagcacctctggggcacagcggccctgggctgcctggtcaaggctactcctcgatcgcgtctgagcgggcctggcaaggcgcatagn

SEQ ID NO: 417927 - DNA, 544 bp, Homo sapiens
  misc_feature: GZ8MTXP02ISFMG.45.67.G01.1.454.CMB.2.raw
  modified_base (354)..(354): a, c, t, g, unknown or other
  modified_base (512)..(512): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccaggccggggggtctctgagactctcctgcgctgcctctggattcaccttcagtgcttatgctctccactgggtccgccaggggccaggcaagggtctgggaggtgggtgggagccgtctacgaaaggntggagaataaaacattattcgcagacctccgtgtggcgccgattcaccatctacaagaaacaactacccggaacacccgtacatcctaccacattacgaaactcccgtagacgaccggagacacggcttagttattctgtgccagagtcgagagtggngtgggacgaactcgactcctacgaactaaccg

SEQ ID NO: 417928 - DNA, 569 bp, Homo sapiens
  misc_feature: GZ8MTXP02G8QG8.45.67.G01.1.454.CMB.2.raw
  modified_base (286)..(286): a, c, t, g, unknown or other
  modified_base (358)..(358): a, c, t, g, unknown or other
  modified_base (396)..(396): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccaggccggggggtctcgtgagactctcctgcgctgcctctggattcaccttcagtgcttangctctccactcgggtccgccgaggggcccaggcaaggggtctgggagtggggtgggagccgtctcgaaaggntggagataaaacattattcgacagacctccgtgtggcnccgattcacccatctccaagaaacaacgtacccgggaaaccaccctacactcctccaacatagaaactccctagacgaccggaggacacggtctagtttacttctgtcgccagtacggtcgaacggagtggacggtggggacgtaacgtcaactcccgtaccgaacttaaccc

SEQ ID NO: 417929 - DNA, 638 bp, Homo sapiens
  misc_feature: GZ8MTXP02G550A.45.67.G01.1.454.CMB.2.raw
  modified_base (357)..(357): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccaggccggggggtctcgtgagactctcctgcgctgcctctggattcaccttcagtgcttatgctctccactcgggtccgccgaggggccaggcaagggtctgggagtggggtgggagccgtctacgaaaggngtggagaagtaaaacattatttcgcaagtacctccgtgtgggccgccgtattccacctatcctaccaagaaaaccacgtacccccgggaaactacccctaacactacctacccaacactacgaaaactccccgtagaacgaccgggacggacacgggactttgtttaacttcgttacggtcgtcccgaaaggtacgggttaccggaaagggtacgtcggggtacgggtgggggaccaaaccgttacgaaaccgttcccccgtaacggtaactttaaacccg

SEQ ID NO: 417930 - DNA, 609 bp, Homo sapiens
  misc_feature: GZ8MTXP02HK9MN.45.67.G01.1.454.CMB.2.raw
  modified_base (361)..(361): a, c, t, g, unknown or other
  modified_base (384)..(384): a, c, t, g, unknown or other
  modified_base (444)..(444): a, c, t, g, unknown or other
  modified_base (452)..(452): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcggggggaggcgtggtccgaggccgggggggtctcgtgagactctcctgcgctgcctctggattcaccttcagtgcttatcgctctccactgggtccgccgaggggccaggcgaagggtctgggagtggggtggacgccgtctacgaaaggntaggagaataaaacattattcgnacgactccgtggtcgcgccgtattcacctagtcctacaagaaactacgtaccccggaaanacccctanactcctaccaacacttacgaaacttcccgagacgaccggagacgacggtcttagtttattcgtcgtgaccaggtacggtagaacgggagtcggggacgggttaacgggggacctaaaccgttacgaaccttccccggtaaccgtaaactttaacccg

SEQ ID NO: 417931 - DNA, 630 bp, Homo sapiens
  misc_feature: GZ8MTXP02F24GC.45.67.G01.1.454.CMB.2.raw
  modified_base (572)..(572): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggaggcgtggtccgaggccgggggggtctcgtgagactctcctgcgctgcctctggattcacttcagtgcttatcgctctccacgtcgggtccgccgaggggccaggcgaaggggtcgtgggaggtggggtgggacgccggtctacgaaagggagtaggaagaaactaaaacattagtttccggacaacggtaccgtccgtggtacgggccgccgtacttacaccatcctaccaaagaaaccaaccgtacccggaaacaccctacactcctaccacactacgaactcccgtagaaccgaccggagacgacggtcttagtttacttcgtcgtcgaccgtaggtacggtacggaacggngtacggggcgggtaacggggacgtaactaccgaacctcccgtaaccgtaacttaaacc

SEQ ID NO: 417932 - DNA, 552 bp, Homo sapiens
  misc_feature: GZ8MTXP02JO3SJ.45.67.G01.1.454.CMB.2.raw
  modified_base (325)..(325): a, c, t, g, unknown or other
  modified_base (352)..(352): a, c, t, g, unknown or other
  modified_base (358)..(358): a, c, t, g, unknown or other
  modified_base (367)..(367): a, c, t, g, unknown or other
  modified_base (375)..(375): a, c, t, g, unknown or other
  modified_base (435)..(435): a, c, t, g, unknown or other
  modified_base (494)..(494): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccaggccggggggtctcgtgagactctcctgcgctgcctctggattcaccttcagtgcttatgctctccactgggtccgccgaggggccaggcaagggtcngggagtgggtgggacgcgtcagaaagntagganaataaacgnttattcanagacctcgtgtcggcgcgtatcaccatccacaagaaactacgaccccgggaacaccctanactctaccactatacaaactcccagacgaccggagacaggtccttagtttactctgtcncgagtcggacgacggatgggacggtgggcaacgtccgaactcccgttacgaacttacc

SEQ ID NO: 417933 - DNA, 565 bp, Homo sapiens
  misc_feature: GZ8MTXP02HQVKH.45.67.G01.1.454.CMB.2.raw
  modified_base (269)..(269): a, c, t, g, unknown or other
  modified_base (463)..(463): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccaggccgggggggtctcgtgagactctcctgcgctgcctctggnttcaccttcagtgcttatgctctccacgtgggtcccgccgaggggcccaggcaaggggtctgggaggtggggtgggagccgtctacgaaaggataggagaataaaacattatttcgacagtactccgtgtcggcgcccgattccaccatctaccaagaaacacgtacccggaaccaccctacactactcccaanactagaaactcccagacgaccgagacacggcttgtttattctgtgtccagacggtacgaagacgtggcggtgggacaactcgacttacccacgtaactaacc

SEQ ID NO: 417934 - DNA, 680 bp, Homo sapiens
  misc_feature: GZ8MTXP02F5WX4.45.67.G01.1.454.CMB.2.raw
  modified_base (368)..(368): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaatggtggaggtcggggggaggcgtggtccgaggccgggggggtctcgtgagactctcctgcgctgcctctggattcaccttcagtgcttatcgctcctccacgtcgggtccgccgaggggcccaggcaaggggtctgggaggtggggtgggacgccgtctacgaaagggngtggaagtaataaaacattagttcgcagacctccggtaggtcggcgacccggtattccgacctactcctaccgaacgtaaaaccaccgttacccccggggaaacctacccctaccacttaccctacccaacactacgaaacttccccgagaaccggaccgggaacggaccgaacgggtcttagttttaactttccgtggtcgacccgtaagggtacgggtaccggtaaagggtacggtcggggtacggggttaacgggggaccgtaaaccggtacctaaaccgttcccccgtaacggaaactttaaaccccg

SEQ ID NO: 417935 - DNA, 673 bp, Homo sapiens
  misc_feature: GZ8MTXP02HVN6Y.45.67.G01.1.454.CMB.2.raw
  modified_base (204)..(204): a, c, t, g, unknown or other
  modified_base (368)..(368): a, c, t, g, unknown or other
  modified_base (636)..(636): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggnggaggtcggggggagcgtggtccagggccggggggtctcgtgagctctctgcgctgcctctggacttcacccttcagtgtcttatcgctcctccagtcgggtccgcgacggggccaggcaaggggtctgggaggtcggggtgggacgtccgtctacgaaagggngtagggaagaaattaaaaacgattacgtttcgacgaacgtaccgtccggtggtcgggccgtacccggtaattcccgaacctaacttcccaacccgaaagaaaaccaaccgtaccccgggaaaacccaacccccttaacaacttacctaacccaactaacgttaacgaaaaccttccccggtaaggaaccggaaacccggggaacggttaacccgacggtaaccttgtttaacgttcgtacgtcgaccgaaggacggtacgagtacggnggcggcggacgacgtacgtacgtacctacgtaactac

SEQ ID NO: 417936 - DNA, 614 bp, Homo sapiens
  misc_feature: GZ8MTXP02ILUQ6.45.67.G01.1.454.CMB.2.raw
  modified_base (258)..(258): a, c, t, g, unknown or other
  modified_base (274)..(274): a, c, t, g, unknown or other
  modified_base (353)..(353): a, c, t, g, unknown or other
  modified_base (587)..(587): a, c, t, g, unknown or other
tcagacgcgatcgacacgaccggtgctcgatttagagtatacatattgggtttgggggaagaggaagactgacggtcctcccaggagttcaggtgctgggcaccttgggcacgggggaggcgtggtccaggccgggggggtctctgagactctcctgcgctgcctctggattcaccttcagtgcttatgctctccactgggtccgccaggggccaggcaagggtctgggaggtggggtgggagccgtctacgaaaggntgggaagaataaaacnttagttcgacagactccgtgtggcgcgatcacatctcaagaaacacgtacccggaacaccctacactctaccactatanaaactccctagacgaccggagacccgacggtcttagtttactttcgtgtcgccgagaggtacggaagtagtggcgggtgggacgaactacactcctacgaactactactacacacgtcgacgcgtagggacgaaacgggtccgtacggtcgccgtcctccgtcacgtcctaccgaccgaacgggccctacggtccgttcctccccgtcggccgtccctcgctaccgaaggtacnccgaccgtcggcggggacacgaccggg

SEQ ID NO: 417937 - DNA, 768 bp, Homo sapiens
  misc_feature: GZ8MTXP02JRA2R.45.67.G01.1.454.CMB.2.raw
tcagacgcgatcgacacgaccggtgctcgatttagagtatacatattgggtttggggggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggaggcggtgggtccgacggccggggggtcgtctgagactctcctgcgctgcctctggattcaccttcagtgcttatgctctccacgtcgggtcccgccgaggggcccgaggcgaaggggtcgtcgggaggtggggtggggagccgtcgtacgaaagggagtacgggaagtaataaaaactagttaatttcgacaggtaaccgttcggtcggtcggggccgtcccggacttaccgtaccattaccctaccgaacgaaaaccgaaaccgtaccccgggaaacctaacccccgtaaacctactacccttacccaactaaaccgttacgaaaacccttaccccgtacggaaccgggaaacccggggaaacggaacccggttaccggtacgttttacggttttaacgtttttaccgtcggtaccggttacccgaaaggggttacggggtaccgggtaaaaggggtcggttacgggggaccggggttacgggggaacgggtaaacctacgtaaacccgttaccccggtaaccgtaaacctttaacctaacgtttaaaacccg

SEQ ID NO: 417938 - DNA, 738 bp, Homo sapiens
  misc_feature: GZ8MTXP02GBY3Z.45.67.G01.1.454.CMB.2.raw
  modified_base (269)..(269): a, c, t, g, unknown or other
  modified_base (288)..(288): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggtattttcctcgtcgctcttttaagaggtgtccaatgtcaggtgcaaatggtggaggtcggggggaggcgtggtccgagggccggggggtctcgtgagactctcctgcgctgcctntggatcctaccttcaggtncttatcgcctcctccgacgtcgggtcccgccggaggggccgaggacgtaagggtcgtagggaggtcgggggtgggacgtccggtacgtaacgaaaagggtacgtagggaagtaaacttaaaacgtattaacgtttccgacacggtaccgttaccggtcggtcgggaccgtaccgtacttaccgaaacccgtactaccctaaccgtaaaccgaaaaccgaacccggttaacccccgggaaaccctaccccgtaacctaccttaccctacccaacacgttaaccaaaaccctcccgtaacggaccgaacccggggtagaccgtacggttctttacgtttacgttcgtacggtacgaccggtaggacgggtacgaaacgggtggtcggggtacgggtaacggggaccgaaacgttccctaaaccgtaccccgtaacggtaaactttaaccccg

SEQ ID NO: 417939 - DNA, 655 bp, Homo sapiens
  misc_feature: GZ8MTXP02IWTVC.45.67.G01.1.454.CMB.2.raw
  modified_base (492)..(492): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggaggcgtggtccgaggccggggggtctcgtgagactctctgcgctgcctctggattcaccttcagtgtctatgctctccacgtcggtccgcgaggggccaggcgaagggtctagggaggtggggtcgggacgccggtcgtacgaaaggcgtaggaagtaaactaaaacgtattaacgtttccgacgaagtaccgtccgtgggtcggaccgtacccgtacgttccacctactcctacccgaaagaaaaccaaccgtacccgggaaaccacccctaanactacctaccaaactacgtacgaaaccttccgagaccgaaccggagacgacgtacgttagtttacgttcgtcgtcgtaccgaggtaaccggtacggtaacgagtcgggacgggtcggggactaaccgtacgtaaccgtccccgtaacggtaaactttaacccg

SEQ ID NO: 417940 - DNA, 607 bp, Homo sapiens
  misc_feature: GZ8MTXP02IOFNS.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaatggtggagtcgggggagcgtggtccaggccggggggtctctgagactctcctgcgctgcctctggattcaccttcagtgcttatgctctccacgtgggtccgccgaggggccaggcgaaggggtctgggaggtggggtgggagccgtctcgaaaggatggaagaataaaacattactttcgacagaccgttccgtggtcgggcgcccgtattccacctactctaccaaacgaaaacaaccgtaccccgggaaactaaccctacactacctaccacactacgaaacctccgtacgacgaccggacggacacggtcttagtttactttcgtgtcgtaccgaggtacggtacggaaggtacgtcgggacggtggggaccgtaacgtcgaactcccgtacgtaacttaaccc

SEQ ID NO: 417941 - DNA, 820 bp, Homo sapiens
  misc_feature: GZ8MTXP02GXAW4.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcgggggaggcgtggtccgaggccgggggggtctcgtgagactctcctgcgctgcctctggattccaccttcagtgcttatgctctccacgtcgggtccgccgaggggcccaggcgaaggggtctgggaggtggggtgggagtcccgtcgtacgaaaacgggagtagggaagaaacgttaaaaacagtttaagtttccggctaaacggtaccgttccccggtgggtcgggcccggtacccggtaaactttccgaaacccctacttacccgttacccgaaacgtaaaacccgtaaacccgttacccccgggggaaaacccaacccccgttaacccaacttaccctaccccgtaaaccaacgtttaacggtaaaaccttcccccggttaggaaacccggaaccccggggaaacgggtaacccgtaaccggggttcccgtttagggtttttaacttttaccggttcggttaccggggttacccccgaaggggtaacggggttaacccgggaaaacgggtaacgggtacggggtccgggggttaacgggggacccgtaaaaccggtttacccgaaaacccgttcccccgttaaacccggtaaacgtttaaaccccg

SEQ ID NO: 417942 - DNA, 789 bp, Homo sapiens
  misc_feature: GZ8MTXP02HFREJ.45.67.G01.1.454.CMB.2.raw
  modified_base (196)..(196): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtncaaatggtggaggtcgggggaggcgtggtccgaggccggggggtctcgtgagactctctgcgctcgcctcgtggattccaccttcgagtgtcttatcgcctctccgtacgtcgggtccgccgacggggccaggcgtaaggggtcgtagggagggtggggtcgggacgtccggtacgtacggaaaacgggtagtagggaaagtaaataaaacgtagttacgtttccggacgtaacggtacccgttccgggtggtacggggcccgtacccggtaactttacccgaaccccttaacgtacccctaacccgtaaaaccgaaaacccgtaaacccggtaacccccggggaaaacccctaaacccccgttaactaaccgttacccctaaccccgaaactaacgttaaccggtaaaacccttcccccggtaaaggaacccgggtaaaccccggggtacggaacccggttaccggttacgtttacggttttacgtttacccgtaggtacccgaccgtaaagggtacgggtaccggtaaagggtcgtcggggtacgggtaacggaccgtaacgtacgtaacctcccgtaacgtaactaaccg

SEQ ID NO: 417943 - DNA, 648 bp, Homo sapiens
  misc_feature: GZ8MTXP02HWT0R.45.67.G01.1.454.CMB.2.raw
  modified_base (275)..(275): a, c, t, g, unknown or other
  modified_base (388)..(388): a, c, t, g, unknown or other
tcagacgcgatcgacacgaccggtgctcgatttagagtatacatattgggtttggggggagacgagcccagcactggaagtcgccggtgcttccatccggtgatcagcactgagcacagaggactcaccatggagtttgggctgagttggattttcctcgtcgcttcttttaagaggtgtccaatgtcaggtgcaaatgggtggaggtcggggggaggcgtggtccgaggccggggggtctcgtgagactctcctgcgctgcctcgtggattccnccttcagtcgcttatcgctctccgacgtgggtccccgccgagggggcccctagggccgtaaggggtcctggggaggttggggtcggggaacgcccggtcgtacgaaaaggggntacggggaaataaataaaaacagtttacgtttccgactaggtaccttccggtggttacgggccgtacccggtatttcccgacctatacctacccaaacgaaactaaccgtacccggaacctaccccgtaacactcgtaccacactacgaaactcccgtagacgaccgagaccacgtctgtttattctgttcgacgtagtaggtacgacggtatcgggcggtagggacgaactcgaactcccgtaccgtactactactacg

SEQ ID NO: 417944 - DNA, 697 bp, Homo sapiens
  misc_feature: GZ8MTXP02JMX3N.45.67.G01.1.454.CMB.2.raw
  modified_base (197)..(197): a, c, t, g, unknown or other
  modified_base (292)..(292): a, c, t, g, unknown or other
  modified_base (353)..(353): a, c, t, g, unknown or other
  modified_base (358)..(358): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgtagttggattttcctcgtcgctcttttaagaggtgtccaatgtcaggtnacaaagtggtggaggtcgggggagcgtggtccgagggccgggggtctcgtgagactctcctgcgctcgctctggacttcaccttcagtgtcttangcctctcccgaccgggtccgcgacggggccaggcgaaggtctaggacgggtgggtgggacnccgtnacgaaggtctagggaactaaactaaaactagttacttcgacacgtacgttccgtgtcggacggtacctacttcaacctacttaccacaaacgaaaaccaacgaccccgggaaaccttacctacaaccttctaaccaacttagtaacggaaacctaccgacgaacggaaccggaacggaaccgtacgtaccgttacggtttaactttacgttgtacgtaccgaacggtacgggtaaacgggtaaacgggtaaacgggggtacgggtacggggtacggggtaaccggtaaaccgtaacccgtaacccgtaaccccgtaaccgtaaaccgtaaccgttaacg

SEQ ID NO: 417945 - DNA, 673 bp, Homo sapiens
  misc_feature: GZ8MTXP02H8PUL.45.67.G01.1.454.CMB.2.raw
  modified_base (382)..(382): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggtattttcctcgtcgctcttttaagaggtgtccaatgtcaggtgacaaagtgggtggaggtcggggggaggcggtgggtccgagggccgggggggtctcgtggagactctcctgcgctcgcctctggattcaccttcagtcgtcttatcgctcctcccgaccggggtcccgccgaggggccagggcgaagggtcgtgggtaggtggggtggacgccgtctacgaaaggngtaggaagaataaaacattacgttcgcacgtactccggtgtcgggcgaccgtacttccgaaccattccaccgaaagaaaacctaaccgtaccccgggaaacctaacccctaacactcctacccaactacgtacgtaaactccccgtaggaaccgacccgggaagaccgtacggctttagtttacgtttcgtaggttacgaccgtaggtacggtacggtaaaggtgtcggggtacggtagggggaaccctaacgtacgtaaccgtaccctaccggtaaacttaacctaaccg

SEQ ID NO: 417946 - DNA, 693 bp, Homo sapiens
  misc_feature: GZ8MTXP02JN068.45.67.G01.1.454.CMB.2.raw
  modified_base (266)..(266): a, c, t, g, unknown or other
  modified_base (375)..(375): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcggggggaggcgtggtccgaggccggggggtctcgtgagactctcctgcgctgcctntggattcaccttcagtgcttatgcctctccacgtcgggtccgccgaggggccaggcgtaaggggtcgtagggaggtggggtggggacgtcccgtacgtacgaaaacggngtacgggaagtaaataaaaacattaacgtttccggactaacggtaacctccggtggtcggccgtaccgtaacttccaacccgtattcccgtaccaaacggaaaacctaaccggtacccccgggaaaccctaacccctaacaacttaccctaccctaactaactacgtaaaacctccccgtaggaaccggtaaccggaacggtaaccgtacggtccttaggttttacttcgtacgtcgaccgaggacggttacgaagggtacgtcgggcggttaaggggacctaacgtaccgaactaccccgtaacgtaacttaaaccg

SEQ ID NO: 417947 - DNA, 643 bp, Homo sapiens
  misc_feature: GZ8MTXP02FGYDW.45.67.G01.1.454.CMB.2.raw
tcagacgcgatcgacacgaccggtgctcgatttagagtatacatattgggtttgggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaagtggtgggaggtcggggggaggcgtgggtccgaggccgggggggtctcgtgagctctcctgcgctgcctctggattcaccttcagtgcttatgcctctccacgtcgggtccgccgacggggccaggcgaagggtcgtgggaggtggggtgggacgccgtcgtacgaaaggatggagaataaaacattattcgcaggacctcgtgtggccgccgattccacctactcctcaacgaaacaacgtaccccgggaaaccacccctaaccactcctacccaacactacgtaaacctacccgtaggaaccggtaaccgggaggaaccgacggtccgttagttttacttacgtcggtcgaccgaaggtacgggtacggaagggtacgtcggggtacggggtcgggggacgtaaccgtacgtaaccgtaccctaaccgaacttaaacccg

SEQ ID NO: 417948 - DNA, 588 bp, Homo sapiens
  misc_feature: GZ8MTXP02FOP7J.45.67.G01.1.454.CMB.2.raw
  modified_base (300)..(300): a, c, t, g, unknown or other
  modified_base (528)..(528): a, c, t, g, unknown or other
tcagacgcgatcgacacgaccggtgctcgatttagagtatacatattgggtttggggggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggagtcggggggaggcgtggtccaggccgggggggtctctgagactctcctgcgctgcctctggattcaccttcagtgcttatgctctccactgggtccnccaggggccaggccaaggggtctgggagtggggtgggagccgtctacgaaaggatgggagataaaaacattagtttcgcagacctccggtgtcgggcgccgtattccacccatcctccaagaaaccaacgtaccccgggaacaccctacactcctaccacatagaaactccctgacgaccggagacacggcttgtttattctgtcgaccgaggacggtacggaaaggntcggggcgtagggggaccgaacgtccgaaactccccgtaccgaactacctaacttaaccg

SEQ ID NO: 417949 - DNA, 600 bp, Homo sapiens
  misc_feature: GZ8MTXP02HX3IK.45.67.G01.1.454.CMB.2.raw
  modified_base (193)..(193): a, c, t, g, unknown or other
  modified_base (367)..(367): a, c, t, g, unknown or other
  modified_base (376)..(376): a, c, t, g, unknown or other
  modified_base (521)..(521): a, c, t, g, unknown or other
  modified_base (560)..(560): a, c, t, g, unknown or other
tcagacgcgatcgacacgaccggtgctcgatttagagtatacatattgggtttgggggggagacgagcccagcactggaagtcgccggtgcttccatccggtgatcagcactgagcacagaggactcaccatggagtttgggctgagttggattttcctcgtcgctcttttaagaggtgtccaatgtcaggtncaatggtggaggtcggggggaggcgtggtccaggccgggggggtctctgagactctcctgcgctgcctctggattcaccttcagtgcttatcgctctccacgtcgggtccgccgaggggccagggccgaagggtcgtgggtaggtggggtggggacgtccgtataccgaaaggntaggggaanaaactaaaacgtattatttcggacacggtactccggtagtcgggcgaccgtacttccacctattccaccaaagaaacaacgtacccgggaacctacctacactccaccacgtatacaacttaccgagacggaccgagacacggtntcgtttattcgtgtcgctaggagtacgagacgtggacgnggggtacaacgtacaaccttcccgactaactactactaac

SEQ ID NO: 417950 - DNA, 668 bp, Homo sapiens
  misc_feature: GZ8MTXP02JZH63.45.67.G01.1.454.CMB.2.raw
  modified_base (349)..(349): a, c, t, g, unknown or other
tcagacgcgatcgacacgaccggtgctcgatttagagtatacatattggggtttggggtctgggagacgagcccagcactggaagtcgccggtgcttccatccggtgatcagcactgagcacagaggactcaccatggagtttgggctgagttggtattttcctcgtcgctcttttaagaggtgtccaatgtcaggtgacaaatggtggaggtcggggggaggcggtggtccgagggccgggggggtctcgtgagactctcctgcgtctgccctcgtggattccaccttcagtgtcttatgccttctccacgtcgggtccgccgtacggggccaggacgaaggggtcgngggtagggtggggtggggacgtccggtacgtacggaaaacgggtagtaggggaaagaaaacttaaaaccatttacgtttcggactaaacggtcccgttcgtagtcggacgccctagttcccgaactctacctaccaaacgaaaccgaccgtaaccccgggaacctaaccctacactactaccaactagtacgaacctccgtacgacgaccgggacgtacgacggtcttacgtttacgttcgtcgtacgcgtaacggtagacggtacggagtcgggtcggtaagggtaccgactacgacctcccgtaacgtaactaaccg

SEQ ID NO: 417951 - DNA, 621 bp, Homo sapiens
  misc_feature: GZ8MTXP02GFBGO.45.67.G01.1.454.CMB.2.raw
  modified_base (386)..(386): a, c, t, g, unknown or other
  modified_base (527)..(527): a, c, t, g, unknown or other
tcagacgcgatcgacacgaccggtgctcgatttagagtatacatattgggtttgggggtctggggagacgagcccagcactggaagtcgccggtgcttccatccggtgatcagcactgagcacagaggactcaccatggagtttgggctgagttggattttcctcgtcgctcttttaagaggtgtccaatgtcaggtgcaaatggtggaggtcggggggagcggtggtccgaggccgggggggtctcgtgagactctcctgcgctgcctctggtatcaccttcagtgcttatgctctccacgtcgggtccgccgaggggccaggcgaaggggtctgggaggtggggtgggagtccgtctacgaaagggtctagggagaataaaacnttatttcgcaggtaccttccgtggtcggccgtaccgacttccaccctatccctaccgaaacgaaaaccacggtaccccgggaaaccacccttacactcctaccacactacgaaactccctagacgaccggaggacacggtnttgtttattcgtcgtacgtccgaggtacggtcggaaggacgtcgggacgggtcggggacgtaacctcgaacctcccgtacggtaaacttaaccg

SEQ ID NO: 417952 - DNA, 742 bp, Homo sapiens
  misc_feature: GZ8MTXP02JUJ3S.45.67.G01.1.454.CMB.2.raw
  modified_base (278)..(278): a, c, t, g, unknown or other
  modified_base (352)..(352): a, c, t, g, unknown or other
  modified_base (376)..(376): a, c, t, g, unknown or other
  modified_base (393)..(393): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaaagtggtggaggtcggggggaggcgtggtccgaggccggggggtctcgtgagactctcctgcgctcgcctctggattccnccttcagtgtccttatcgctctccacgtcgggtccgccgaggggcccaaggcgaaggggtcagggaggtggggngggacgccggtctacgaaaagggntagggaagaataaaacnttaactttcgacagtaccgtcggtgtcggccgtacccggacttcccaacccgtacttaccgtacccaaagaaaacccaaccggttaacccccgggaaaaccctaacccccgtaacaaccttaccacccctaaactaacttaacgtaaaacccgttcccctaacggaaacccgggaaacccgggggaacggtaacccggaacgggttcccgtttaaggtttttaaaccgtttccggtttacggttacgggaacccgtaagggttaccgggtaccgggaaaaggggtcgttaacggggtcgggtaacgggggactaaccgtacgaaacctcccgtaaccgtacttaaaccc

SEQ ID NO: 417953 - DNA, 665 bp, Homo sapiens
  misc_feature: GZ8MTXP02II8TL.45.67.G01.1.454.CMB.2.raw
  modified_base (227)..(227): a, c, t, g, unknown or other
  modified_base (257)..(257): a, c, t, g, unknown or other
  modified_base (272)..(272): a, c, t, g, unknown or other
  modified_base (414)..(414): a, c, t, g, unknown or other
tcagacgcgatcgacacgaccggtgctcgatttagagtatacatattgggtttggggggaagaggaagactgacggtcctcccaggagttcaggtgctgggcaccttgggcacgggggaggcgtggtccagccgggggggtctctgagactctcctgcgctgcctctggattcaccttcagtgcttatgctctccactgggtccgccagggggccaggcaagggtcngggagtggggtgggagccgtctacaaaggntggaagaataaaacntatttcgcagactcgtgtggcgcgatcacatctccaagaaacaacgtccccgggaaacaccctaacatctaccacatacgaaactccctagacgaccggagacccgacggcttgtttattctgtcgccgagaggtcgaaggngtgggcggtggggacaacgtacaacgtccctacgaaacttactacctaactacaagtcggaccgccggttaggggaaccgaaaacggggtcccgtcgggtaccgcccgtacctccgtacgacgtccttacccgaaccgaacgggcccctacgttccgggttacccttcccccgtgggccccgtcccgttcggccctaccggaaggaccgtcccgtacccggttcgggtaccgggggaccaacggcccgggg

SEQ ID NO: 417954 - DNA, 742 bp, Homo sapiens
  misc_feature: GZ8MTXP02GA3B0.45.67.G01.1.454.CMB.2.raw
  modified_base (281)..(281): a, c, t, g, unknown or other
  modified_base (456)..(456): a, c, t, g, unknown or other
tcagacgcgatcgacacgaccggtgctcgatttagagtatacatattggggtttggggtctgggagacgagcccagcactggaagtcgccggtgcttccatccggtgatcagcactgagcacagaggactcaccatggagtttgggctggagttggattttcctcgtcgctcttttaagaggtgtccaatgtcaggtgacaaagtgggtgggagggtcggggggaggcggtcgggtccgagggccgggggggtctcgtggagactctcgtgcgctgccctntggtattccactcagtgtctatcgctcctccacgtcgggtccgccgagggccgaggacgtagggtcgtgggagggtggggtcgggacgccgtacgtacgaaggtagtggaaagtaaactaaaacattacgtcgacgagtaccgtcgtaggtcggccgtacgtacttccgaacctnttacccaaaccgtaagaaaaccacccggtaaccccggaaacctacccctaactaaccttaccacccgtaaatacggtaacgaaactcccgtaaggaaccgaacgggtacgaacgtaccgggttactttacgtttaacgttccgtaggtacccggtaaccgtaagggggtaacccgggttaaggaaacgggggtcccggtagggggtacccggggaacgggggaaccggtttaaccctaacccgttaaccggttacccccggtaaacgttaaacccctttaaacccg

SEQ ID NO: 417955 - DNA, 611 bp, Homo sapiens
  misc_feature: GZ8MTXP02JDNAZ.45.67.G01.1.454.CMB.2.raw
  modified_base (162)..(162): a, c, t, g, unknown or other
  modified_base (325)..(325): a, c, t, g, unknown or other
  modified_base (345)..(345): a, c, t, g, unknown or other
  modified_base (354)..(354): a, c, t, g, unknown or other
  modified_base (359)..(359): a, c, t, g, unknown or other
  modified_base (368)..(368): a, c, t, g, unknown or other
  modified_base (375)..(375): a, c, t, g, unknown or other
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttccncgtcgctcttttaagaggtgtccaatgtcaggtgcaaatggtggagtcgggggaggcgtggtccaggccggggggtctctgagactctcctgcgctgcctctggattcacttcagtgcttatgctctcccactgggtccgccaggggcccaggcaaggggtcngggagtgggtgggagccgtntcgaaaggntgganataaaacgntattcgnagactccgtgtggcgccgattcaccatctccagaaacactcccgggaaacacccgtacatacctaccacatagaaactcccgtagacgaccggaggtaccacggcttagtttacttcgtagtcgacccgtaaggtacgggttacggaaagggtacgttcggggaccggggttaagggggaccggtaaaaccttaccgaaaccgtttacccccgtaaccggtaaactttaaaccccg

SEQ ID NO: 417956 - DNA, 749 bp, Homo sapiens
  misc_feature: GZ8MTXP02I63J2.45.67.G01.1.454.CMB.2.raw
tcagacgcgatcgacacgaccggtgctcgatttagagtatacatattgggtttggggtctgggagacgagcccagcactggaagtcgccggtgcttccatccggtgatcagcactgagcacagaggactcaccatggagtttgggctgagttggattttcctcgtcgctcttttaagaggtgtccaatgtcaggtgcaagtggtggaggtcggggggaggcggtggtccgaggccgggggggtctcgtgagactctcctggcgctcgcctcgtggattccaccttcagtgtcttatcgctcctccacgtcgggtccgccggaggggcccaggcgaaggggttcctaggggtaggtggggtagggacggtccggtacgtacggaaaacgggtacgtaggggaaataaacgtaaaaactagttacgtttcggactaacggtaaccgttccggtgggtacgggccgtacccgtactttaccaaccctactccgttaccaaacgaaaacctaacccggtaacccccggggaaaaccctaaccccgtaacctaacctaccctaccaaacctaacgtaacgtaaaaccttaccccgaaggaaccgaccgggacggaccgtaccggtaccgtttacgttttcttaccggttacgtacgaccggtaggtacgggttaacggaagggtaacgtcgggacgggggtaacggggaacctaacgttaccgaaaccgttcccgtaaccgaacgtttaaaccc

SEQ ID NO: 417957 - DNA, 527 bp, Homo sapiens
  misc_feature: GZ8MTXP01ATKYJ.2.25.C03.1.454.CMB.2.raw
  modified_base (200)..(200): a, c, t, g, unknown or other
  modified_base (389)..(389): a, c, t, g, unknown or other
  modified_base (432)..(432): a, c, t, g, unknown or other
  modified_base (508)..(508): a, c, t, g, unknown or other
  modified_base (527)..(527): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctctcctgcagggccagtcagagtgttaccggcacgtatgtagcctggtaccagcagaaacctggccaggctcccagactcctcatctctggggcatccagcacgggcccccggcatcccagacaggttcagtggcagtgggtctgggacagaagttcaactctcacaatcagcagactggancctgaagtatttgctagtgtatttctgtcaacaagtatcgtanccccttagtcggacgttcggccagggggtacccaagggtggaagtaacaaacgaactgttagggctgcgaccatcngtcttcattcttcccgctn

SEQ ID NO: 417958 - DNA, 588 bp, Homo sapiens
  misc_feature: GZ8MTXP01EZWX2.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgtaccggnacgtatgtagcctggtaccagcagaaactggccaggctccagactctcatctctgggcatccagcacgggcccccgcactcccagacaggttcagtggcagtgggtctggggacagaagttcaactctcacatcagcagactgagcctgaatattttgctagtgttattctgtacaaactaatactcgttacgtcccccgttacgtcggtacgttcggaccgacgggggtaaccgaaggggtacggaaaggttaaccgaaaacggttaaacgtaggttacggccgttaggaccgaaccttacttccgtcggttccttcctacttcccgtttccccgttaacccgtaacg

SEQ ID NO: 417959 - DNA, 609 bp, Homo sapiens
  misc_feature: GZ8MTXP01BIHTU.2.25.C03.1.454.CMB.2.raw
  modified_base (201)..(201): a, c, t, g, unknown or other
  modified_base (239)..(239): a, c, t, g, unknown or other
  modified_base (373)..(373): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctcgtgggcatccagccgacgggcccccggcacgtccccagaccaggttcaggtggcaggtgggtctgggacagaagttcnctctacacaatcagcagactggacgcgtagaagtagttttgactagttgttattctgtactaactaagttacttacggttacgtcccccgtttaaggtcggtaaccggtttcgggacccgtaacgggggtaaccctaaaggggttacggaaacggtaacgtaaaacggttaacgtcggttcggtacgtgaccgacccgttattcctgttccttcacttccgttcccgccgttaacg

SEQ ID NO: 417960 - DNA, 538 bp, Homo sapiens
  misc_feature: GZ8MTXP01D18KO.2.25.C03.1.454.CMB.2.raw
  modified_base (201)..(201): a, c, t, g, unknown or other
  modified_base (241)..(241): a, c, t, g, unknown or other
  modified_base (368)..(368): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctccagactcctcatctctggggcatccagcacgggcccccggcactcccagacaggttcagtggcaggtgggtctgggacagaagttcnctctcaacatcagcagactgagctgaagattttgctagtgttattctgtacaacaattactcgtacgtaccccttacgtcggtacgtttcggaccgtaggggaccaagggtggaaagtaacaaacggaactggttggctgcgacatctgtcttcattccttcccgctaac

SEQ ID NO: 417961 - DNA, 605 bp, Homo sapiens
  misc_feature: GZ8MTXP01EN40E.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctctggggcatccagcacgggcccccgcactcccagacaggttcagtggcagtgggtctggggacagaagttcaactctcacaatcagcagactggagcctagaagtattttaggctagttgttaatttcgtagtacaaactaattagttaccgtacgtccccctttaacggtcggtaccgtttcggaccgaagggggtaccctaaagggtacgggaaagttaacgaaaacggttaaccgtggttacggacgttacggaccgacccttaattccgttgttcctttcaactttcccttccccggttccttaacg

SEQ ID NO: 417962 - DNA, 527 bp, Homo sapiens
  misc_feature: GZ8MTXP01EGND3.2.25.C03.1.454.CMB.2.raw
  modified_base (242)..(242): a, c, t, g, unknown or other
  modified_base (502)..(502): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaagagccaccctctcctgcagggccagtcagagtgttaccggnacgtatgtagcctggtaccagcagaaacctggccaggctcccagactcctcatctctggggcatccagcacgggcccccgcatcccagacaggttcagtggcagtgggtctggggacagaagttcaactctcacatcagcagactggagcctgaagtattttgctagtgtattctgtacaacaatatcgtacgtccccttagtcgacgttcggaccgtaggggaccaagggtcgaagtaacaaacgactgttaggctgcncatctgtcttcattctcccgctaac

SEQ ID NO: 417963 - DNA, 608 bp, Homo sapiens
  misc_feature: GZ8MTXP01AGOOT.2.25.C03.1.454.CMB.2.raw
  modified_base (200)..(200): a, c, t, g, unknown or other
  modified_base (237)..(237): a, c, t, g, unknown or other
  modified_base (313)..(313): a, c, t, g, unknown or other
  modified_base (359)..(359): a, c, t, g, unknown or other
  modified_base (385)..(385): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctccgaggggaaangccacctctcctgcagggccagtcagagtgtaccggnagtatgtagcctggtaccagcagaaacctggcaggctccagactctcatctctgggcatccagcacgggccccggnactcccagacaggttcagtggcagtgggtctgggacagaacgttcnctctacactaatcagcagactggganccgtagaagtatttgctagtgttaatttctagtacaaacaattactacgttaacgcccccgtttaggtcggtaccgtttcgggaccgagggggacccaaagggttcggaaacgttaacgaaaacgttacgtacggttaggaccgttacggccgttaacccgttacgttaaccgttacgttccgtttaccctaactttccccgtttccccggcccgtttaaccg

SEQ ID NO: 417964 - DNA, 537 bp, Homo sapiens
  misc_feature: GZ8MTXP01BZMPS.2.25.C03.1.454.CMB.2.raw
  modified_base (201)..(201): a, c, t, g, unknown or other
  modified_base (240)..(240): a, c, t, g, unknown or other
  modified_base (401)..(401): a, c, t, g, unknown or other
  modified_base (505)..(505): a, c, t, g, unknown or other
  modified_base (512)..(512): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggccaggctcccagactcctcatctctggggcatccagcacgggcccccgcactcccagacaggttcagtggcaggtgggtctggggacagaagttcaactctcacaatcagcagactggagcctgaagtnttttaggctagttgtatttctgtacaactaattactcggtacgtccccgttagtcggacgttcggccgtaggggaccaagggtcggaagtaacgaaacgactgnggctgcnccatctgtcttcattcctccgctaa

SEQ ID NO: 417965 - DNA, 547 bp, Homo sapiens
  misc_feature: GZ8MTXP01B16IE.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgtaccggnacgtatgtagcctgggtaccagcagaaacctggccaggctcccagactcctcatctctggggcatccagcacgggcccccggcactcccagacaggttcagtggcagtgggtctgggacagaagttcaactctcacatcagcagactggagctgaagtatttgctagtgtattctgtacaactaatatcgtacgccccttacgtcggtacgtttcggacccgtagggggacccgtaaagggtcgggaaagttaacgaaacgacgtggttaggctggcaccagtctagtcttcacttcttcccgctaac

SEQ ID NO: 417966 - DNA, 529 bp, Homo sapiens
  misc_feature: GZ8MTXP01EHHLX.2.25.C03.1.454.CMB.2.raw
  modified_base (200)..(200): a, c, t, g, unknown or other
  modified_base (238)..(238): a, c, t, g, unknown or other
  modified_base (317)..(317): a, c, t, g, unknown or other
  modified_base (388)..(388): a, c, t, g, unknown or other
  modified_base (412)..(412): a, c, t, g, unknown or other
  modified_base (509)..(509): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctctggggcatccagcagggccccgnatcccagacaggttcaatggcagtgggtctggggacagaagttcaacgtctcaacaatcaagcagactganctagaagattttgcagtgtattcngtacaactaatatcgtacgccccttagtggaccgttcggaccgtaggggtaaccaaggtggaagtaacaaacgaactgttagggctggcacatcgtntcttcattccttccgcctaa

SEQ ID NO: 417967 - DNA, 635 bp, Homo sapiens
  misc_feature: GZ8MTXP01A4O26.2.25.C03.1.454.CMB.2.raw
  modified_base (202)..(202): a, c, t, g, unknown or other
  modified_base (240)..(240): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccacctctcctgcagggccagtcagagtgttaccggnacgtatgtagcctggtaccagcagaaacctggccaggctcccagactcctcatctcgtggggcatccagcgacgggcccccggcactcccagacgaggttcagtggcacggtgggtcgtggggacaggtaacgttcgaactctacacaatcagcagacgtggagctagaagtattttgactagtgttattctagtactaaactaattactaccggttaaccgtccccgtttacggtcggtaccggtttaccgggaccggtaacgggggtaacccgaaaggggtacggaaaggtaaccgaaaacggttaaccgtagggttcgggacgttacggaccttaccgttacgttcgttcggttccgtttacctacgttccctttccccgaacctttaaccg

SEQ ID NO: 417968 - DNA, 564 bp, Homo sapiens
  misc_feature: GZ8MTXP01DJAWZ.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaatctggccaggctcccagactcctcatctctggggcatccagcacgggcccccggcactcccagacaggttcaatggccaggtgggtctgggacaagagttcactctcacaatcagcagactggagcctgaagtattttgctagtgttatttctagtacaaacgtaattattacgtacgtacccccttacggtcggtaccggtttcgggccgtagggggaccctaaaggggttgggaaacgttacgaaacggaacgttggtaggcttggcaccaatctgttctcacttccttcccgtcc

SEQ ID NO: 417969 - DNA, 542 bp, Homo sapiens
  misc_feature: GZ8MTXP01DNUSY.2.25.C03.1.454.CMB.2.raw
  modified_base (201)..(201): a, c, t, g, unknown or other
  modified_base (238)..(238): a, c, t, g, unknown or other
  modified_base (360)..(360): a, c, t, g, unknown or other
  modified_base (508)..(508): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgtaccggnacgtatgtagcctggtaccagcagaaacctggccaggctcccagactcctcatctctggggcatccagccacgggccccgcatcccagacaggttcagtgcagtggtctgggacagagttcnctctcaacaatcagcagactggagctagaagtatttgactagttgttattactgtacaaactaattaactcggtaccgtcccccgtttaggttcggtaccgtttcggaccgagggggtacctaaggtcggaagtaacaaacgactggngctgacttcatctgtcttcacttctcccgctaac

SEQ ID NO: 417970 - DNA, 548 bp, Homo sapiens
  misc_feature: GZ8MTXP01ADJFE.2.25.C03.1.454.CMB.2.raw
  modified_base (200)..(200): a, c, t, g, unknown or other
  modified_base (208)..(208): a, c, t, g, unknown or other
  modified_base (237)..(237): a, c, t, g, unknown or other
  modified_base (321)..(321): a, c, t, g, unknown or other
  modified_base (392)..(392): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccacctntcctgcagggccagtcagagtgtaccggnacgtatgtagcctggtaccagcagaaacctggccaggctcccagactcctcatctcgtggggcactccagcacgggcccccggnatccccagacaggttcagtggcagtgggtctggggacagaagttcaactctcacaatcagcagactggacncgtagaagtattttgctaagttgttatttctgtacaactaatactcgtacgtccccttaagtcggtacgttcgggaccacggggtaccaacgggtggaaaggtcgaaacggaactggttagctggcaccatctgtcttcacttcttcccgctaacg

SEQ ID NO: 417971 - DNA, 528 bp, Homo sapiens
  misc_feature: GZ8MTXP01CWHAI.2.25.C03.1.454.CMB.2.raw
  modified_base (200)..(200): a, c, t, g, unknown or other
  modified_base (491)..(491): a, c, t, g, unknown or other
  modified_base (498)..(498): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcaccctgtctttgtctccaggggaaanagccacctctcctgcagggccagtcagagtgttaccggcacgtatgtagcctggtaccagcagaaacctggccaggctcccagactcctcatctctggggcatccagcacgggcccccggcactcccagacaggttcagtggcagtgggtctgggacagaagttcaacgtctcacaatcagcagactggagcctgaagtatttgctaagtgtattctagtcaactaatatcgtacgccccttagtcgacgttcgaccgtaggggaccaaggtcgaagtcgaaacgacgtgngactgcnccgatctgtcttcacttccttcccgctaac

SEQ ID NO: 417972 - DNA, 538 bp, Homo sapiens
  misc_feature: GZ8MTXP01B4VZL.2.25.C03.1.454.CMB.2.raw
  modified_base (202)..(202): a, c, t, g, unknown or other
  modified_base (239)..(239): a, c, t, g, unknown or other
  modified_base (318)..(318): a, c, t, g, unknown or other
  modified_base (347)..(347): a, c, t, g, unknown or other
  modified_base (534)..(534): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccacctctcctgcagggccagtcagagtgtaccggnacgtatgtagcctggtaccagcagaaacctggccaggctccagactcctcatctctggggcatccagcacgggccccgnatcccagacaggttcagtggcagtgggtntgggacagaagttcaactctcacaatcagcagactggacgcctagaagtattttagactagttgttattctagtacaactaatactacgtacgtccccgttagtcggtacgttcggaccgaggggtacctaaggtggaagtaacgaaacgaacgtggttggctgcacatctgtcttcattctcccgntaac

SEQ ID NO: 417973 - DNA, 535 bp, Homo sapiens
  misc_feature: GZ8MTXP01ESA3P.2.25.C03.1.454.CMB.2.raw
  modified_base (201)..(201): a, c, t, g, unknown or other
  modified_base (510)..(510): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggcacgtatgtagcctggtaccagcagaaacctggccaggctcccagactcctcatctctggggcatccagcacgggcccccggcactccccagacaggttcagtggcaggtgggtctggggacagaagttcaactctcacatcagcagactggagcctgaagtattttgctagtgttattctagtacaactaatatcgtacgtccccttagtcggacgttcggaccgacggggtaccaaggtggaagtaacaaacgttaactgttggctgcncatctgtcttcacttctccgctaac

SEQ ID NO: 417974 - DNA, 686 bp, Homo sapiens
  misc_feature: GZ8MTXP01AUUA1.2.25.C03.1.454.CMB.2.raw
  modified_base (201)..(201): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctccgaggggaaangccacctctcctgcagggccagtcagagtgttaccggcacgtatgtagcctggtaccagcagaaacctggccaggctcccagactcctcatctcgtggggcatccgagcgaccgggccccgcactcccagacgaggttacagtggacaggtcgggtctaggggacagtaacgttcaacgttctacgaactaatcgagacgaagacgtagggacgtaccgtaggtaacgttatttacggactaggttgtttaatttcgtagttaacctaaacgtaagttaacgttaccggttaaccgtaccccccgtttaacgggtcgggtaacccggtttaccggggacccggtaaacgggggtaacccgtaaagggttacgggaaacggtaaccgaaaacggttaacgtacggttcgggaccgttcggacccgttaccttacgttccgttacggtttcctttaccgtactttcccgtttccccggccttaaccg

SEQ ID NO: 417975 - DNA, 635 bp, Homo sapiens
  misc_feature: GZ8MTXP01AGBQO.2.25.C03.1.454.CMB.2.raw
  modified_base (200)..(200): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangcccaccctctcctgcagggccagtcagagtgtaccggnacgtatgtagcctggtaccagcagaaacctggccaggcctccagactcctcatctcgtgggcatccagccgaccgggcccccggcactccccgaagaccgtaggttcaggtcggctaggtgggtcgtgggacagtacgttcaacttctacaacatcagcagacgtggacgcctaggaagttattttggactagttggttactttcgtagtacaaacaagttactacggtaccgtacccccgttaggtcggtaccggttaccggaccggtaacgggggtaccgtaaggggtacggaaacggttaacgaaacggttaacgttgggttacggtcgttcggaccttaccgttacttccgtcgttcctttacctacggtttcccttcccgaaccttaaccg

SEQ ID NO: 417976 - DNA, 590 bp, Homo sapiens
  misc_feature: GZ8MTXP01B42WC.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgtaccggnacgtatgtagcctggtaccagcagaaacctggccaggctcccagactcctcatctctggggcatccagcacgggcccccggcactcccagacaggttcagtggcaggtgggtctgggacagaagttcaactctcacaatcagcagactggagctgaagtattttgctagtgttattctagtacaaacaattactcgttaacgtccccctttaggtcggtaccgttccggacccgtaagggggtacccgtaaaggggtacggaaagtaaccgaaaacggaacgttaggttcggtacgttcggaccgacccttattccgtagttccttacacttccgttccccgttcgtaacg

SEQ ID NO: 417977 - DNA, 533 bp, Homo sapiens
  misc_feature: GZ8MTXP01BKYNR.2.25.C03.1.454.CMB.2.raw
  modified_base (201)..(201): a, c, t, g, unknown or other
  modified_base (239)..(239): a, c, t, g, unknown or other
  modified_base (507)..(507): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctctggggcatccagccgacgggcccccggcactccccagacgaggttcagtggcagtgggtctgggacagaagttcaactctcacaatcagcagactggagcctgaagtattttgctagtgttattctgtactaaacaatatcgtacgtccccttaggtcggacgttcggcgaggggtaccaagggtcggaagtcaaacgactgttaggctgcnccatctgtcttcattcctccgctaac

SEQ ID NO: 417978 - DNA, 582 bp, Homo sapiens
  misc_feature: GZ8MTXP01BJ19K.2.25.C03.1.454.CMB.2.raw
  modified_base (202)..(202): a, c, t, g, unknown or other
  modified_base (240)..(240): a, c, t, g, unknown or other
  modified_base (376)..(376): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccacctctcctgcagggccagtcagagtgttaccggnacgtatgtagcctggtaccagcagaaacctggccaggctcccagactcctcatctcgtggggcatccagccgacgggcccccggcactccccagacgaggttcaggtggcaggtgggtcgtgggacaggaagttcnctctcacaatcagacagactggagcctgaagtattttgactagttgttattcgtagtacaaactaagttacttacgttaccgtaccccgtttacggtcggtacggttcggaccgacggggtaaccgaagggtacggaagtaacgaaacggacgtaggttggtacgtgttccgacttatctgttcttctacttccttccgcctaacg

SEQ ID NO: 417979 - DNA, 534 bp, Homo sapiens
  misc_feature: GZ8MTXP01BN77N.2.25.C03.1.454.CMB.2.raw
  modified_base (201)..(201): a, c, t, g, unknown or other
  modified_base (240)..(240): a, c, t, g, unknown or other
  modified_base (404)..(404): a, c, t, g, unknown or other
  modified_base (499)..(499): a, c, t, g, unknown or other
  modified_base (519)..(519): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtacccagcagaaacctggccaggctccagactcctcatctcgtggggcatccagcgacgggcccccggcactcccagacaggttcaggtggcaggtgggtctggggacagaacgttcaactctcacatcagcagactggagctgaagtnttttagctagttgttattctgtacaactatatcgtacgacccttagtcggtacgttcggacgaggggtaccgaaggtgaagtaacaacgacgtgngctgccacgatctgtcttcncttccttccgctaac

SEQ ID NO: 417980 - DNA, 608 bp, Homo sapiens
  misc_feature: GZ8MTXP01DT1OM.2.25.C03.1.454.CMB.2.raw
  modified_base (202)..(202): a, c, t, g, unknown or other
  modified_base (241)..(241): a, c, t, g, unknown or other
  modified_base (318)..(318): a, c, t, g, unknown or other
  modified_base (365)..(365): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaancgccaccctctcctgcagggccagtcagagtgtaccggnacgtatgtagcctggaccagcagaaacctggccaggctccagactcctcatctctgggcatccagcacgggccccgnactcccagacaggttcaggtgcgagtggtctgggacaggaagttacncgtctacgacatccgagtcagactggagcgtagaagttatttgctagtgttattctagtacaaataagtacgttacgtaccgtccccgttaaggtcggtaacgtttccgggacccgtacggggggtaaaccctaaaggggtacggtaaaggtaaccgtaaaacgttaacgtacggttggacgttcgacgaccttaacgttcgttacgtcctttcaacgtttccgttccccggttccgttaacg

SEQ ID NO: 417981 - DNA, 558 bp, Homo sapiens
  misc_feature: GZ8MTXP01BMRL7.2.25.C03.1.454.CMB.2.raw
  modified_base (201)..(201): a, c, t, g, unknown or other
  modified_base (240)..(240): a, c, t, g, unknown or other
  modified_base (527)..(527): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaactggcaggctccagactcctcatcctcgtggggcactccagccgacgggcccccgcactcccagacaggttcaggtgctaggtgggtctgggacagaagttcaactctacaacaatcagcagactggagccgtagaagtagtttagctagttgtatttctagtactaactaatattacgtacgtaccccgttagtcggtacgttcggtaccgaggggtaaccgaaggtacggaagtaacaaacgacgtagttggcgtgccncactctgtcttcacttccgttcccgcgtaac

SEQ ID NO: 417982 - DNA, 644 bp, Homo sapiens
  misc_feature: GZ8MTXP01A2KY6.2.25.C03.1.454.CMB.2.raw
  modified_base (201)..(201): a, c, t, g, unknown or other
  modified_base (239)..(239): a, c, t, g, unknown or other
  modified_base (351)..(351): a, c, t, g, unknown or other
  modified_base (364)..(364): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccgaggggaaangccacctctcctgcagggccagtcagagtgttaccggnacgtatgtagcctggtaccagcagaaacctggccaggctcccagactcctcatctctgggcatccagcacgggccccgcactcccagacaggttcagtggcacggtggtcgngggacagagttcncgtctcgacatcagacacgacgtggagcctagaagttagttttaggactaaggttggttactttcgtcgtaactaaacctaaagttaacgtaccggttaaccgtacccccgtttacggtacggtaccgtttccgggaccggtaacggggaacccgtaagggtacgaaacggtaacgtaaaacgttacggtacggttaggtccgtaggaccaccgttaacgtccgtttgggttccctttacctaacgtttaccccgtttccccggttaacccgtttaaccg

SEQ ID NO: 417983 - DNA, 655 bp, Homo sapiens
  misc_feature: GZ8MTXP01AJXOJ.2.25.C03.1.454.CMB.2.raw
  modified_base (200)..(200): a, c, t, g, unknown or other
  modified_base (209)..(209): a, c, t, g, unknown or other
  modified_base (228)..(228): a, c, t, g, unknown or other
  modified_base (238)..(238): a, c, t, g, unknown or other
  modified_base (382)..(382): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccgaggggaangccaccctntcctgcagggccagtcagngtgtaccggnacgtatgtagcctggtaccagcagaaacctggccaggctacccagacctcctcactctcgtcggggcactccacggccgaccgggcccccgcactcccagacgaggttcgaggtggcgacggtgggtcgtgggacagacgttcnctctacacatcagcagacgtaggacgtaccgtaggtaagttagttttaggacttaggtttagtttacttttcgttacggtacctaaacgtaaactttacgtaccgttaaccgtacccccgtttaggtcggtaccggttccgggaccgtaacgggggtaaccgtaaacgggtacggaaacggtaacgaaaacggttaacgtcggttacggtcgtcgacgttaccttacgttccttacgttcctttctaccgtttcccgtttcccgccgttaacg

SEQ ID NO: 417984 - DNA, 572 bp, Homo sapiens
  misc_feature: GZ8MTXP01D032N.2.25.C03.1.454.CMB.2.raw
  modified_base (201)..(201): a, c, t, g, unknown or other
  modified_base (239)..(239): a, c, t, g, unknown or other
  modified_base (317)..(317): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcaccctgtctttgtctccgaggggaaangccacctctcctgcagggccagtcagagtgttaccggnacgtatgtagcctggtaccagcagaaacctggccaggctccagactcctcatctctgggcatccagcacgggccccgnactcccagacaggttcagtggcagtgggtctgggacagaagttcaacgtctcaacaatcagcagactggagctagaagtattttagctagttgttatttctgtactaacgtaattacttacgtacgtaccccgttacgtcggtacggtttcggaccgaggggtaacccgtaagggtacggaaagtaacgaaacggactcggttaggcgttcggacttaccttagtcgttcgtcttcacttccttcccgccttaac

SEQ ID NO: 417985 - DNA, 696 bp, Homo sapiens
  misc_feature: GZ8MTXP01DE2EQ.2.25.C03.1.454.CMB.2.raw
  modified_base (202)..(202): a, c, t, g, unknown or other
  modified_base (241)..(241): a, c, t, g, unknown or other
  modified_base (373)..(373): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangcccaccctctcctgcagggccagtcagagtgtaccggnacgtatgtagcctggtaccagcagaaacctggccaggctcccagactcctcatctctggggcatccagccacgggcccccggcactccccagacaggttcagtggcgagtgggtctgggacaggaacgttcnctctacgaactaatcacgtcgaagacctggagtccgtagaagtagttttagactagttggtttaactttcgtaggttacctaaaacgtaaagttaacgttccggttaaaccgttaccccccgtttaagggtaccgggttaaccggtttccggggacccggtaacgggggtaaccccgtaaagggggttacgggaaagttaaacccgggaaaacgttaaacggttcggttacgggtaccgttacgggaccttaccgttaagttcccgtttaacggttcccgtttactaacctttacccgtttcccccggttaacctttaaccgg

SEQ ID NO: 417986 - DNA, 572 bp, Homo sapiens
  misc_feature: GZ8MTXP01D4NYI.2.25.C03.1.454.CMB.2.raw
  modified_base (200)..(200): a, c, t, g, unknown or other
  modified_base (239)..(239): a, c, t, g, unknown or other
  modified_base (321)..(321): a, c, t, g, unknown or other
  modified_base (400)..(400): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcacctgtctttgtctccgaggggaaangccaccctctcctgcagggccagtcagagtgttaccggnacgtatgtagcctggtaccagcagaaacctggccaggctccagactcctcatctcgtggggcatccagcgacgggcccccgnactcccagacgaggttcaggtggctaggtgggtctggggacaggtaacgttcaacgtctacacaatcagcagactggancgtagaatagttttgcgtagttggttatttctagttacaaactaagttacgtacgtacgtaccccttagtcggtaccgttcggaccgaggggtaccgtaaggtacggaagtaacaaacggactggttagacgtcgacgttacagtctgttcttcacttccgtcccgcgtaac

SEQ ID NO: 417987 - DNA, 526 bp, Homo sapiens
  misc_feature: GZ8MTXP01A4MMO.2.25.C03.1.454.CMB.2.raw
  modified_base (201)..(201): a, c, t, g, unknown or other
  modified_base (240)..(240): a, c, t, g, unknown or other
  modified_base (320)..(320): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggccaggctcccagactcctcatctctggggcatccagcaggcccccggnatcccagacaggttcagtgcagtgggtctggggacagaagttcaactctcacaatcagcagactgagctgaagattttgcagtgtatttctgtacaaacaatatcgtagcccccttaagtggacgttcggaccaggggaccaaaggtggaagtaacgaaacgaactgttaggctgcaccatctgtctctattcttccgttcctaac

SEQ ID NO: 417988 - DNA, 603 bp, Homo sapiens
  misc_feature: GZ8MTXP01AM7SQ.2.25.C03.1.454.CMB.2.raw
  modified_base (202)..(202): a, c, t, g, unknown or other
  modified_base (241)..(241): a, c, t, g, unknown or other
  modified_base (371)..(371): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangcccaccctctcctgcagggccagtcagagtgtaccggnacgtatgtagcctggtaccagcagaaacctggcaggctccagactcctcatctcgtgggcatccagcacgggcccccgcactcccagacgaggttcaggtggcgaggtgggtcgtggggacagaagttcnctctcaacatcagcagactggacgctagaagtagttttagctagttgttaatttctagtactaaactaagttacgttaccgttaccgtcccccgtttaacggtcggtaccggttcgggaccgacgggggtaaccgtaagggtacggaaggtaacgaaacggttacgtggttacggcgtcgccgttaccacgttaacgtcgttccttctacttcccgtcccgttccgttaacg

SEQ ID NO: 417989 - DNA, 665 bp, Homo sapiens
  misc_feature: GZ8MTXP01AEDZ7.2.25.C03.1.454.CMB.2.raw
  modified_base (202)..(202): a, c, t, g, unknown or other
  modified_base (241)..(241): a, c, t, g, unknown or other
  modified_base (377)..(377): a, c, t, g, unknown or other
  modified_base (432)..(432): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccaccctctcctgcagggccagtcagagtgttaccggnacgtatgtacgcctggtaccagcagaaacctggcaggctcccagactctcatctcgtgggcactccagccgacgggcccccgcactcccgagactaggttcaggtggctacggtggtcgtgggacagtaacgttcnctctcacatcagcagacgtggacgtcgtaggaagttagttttcgacgttaggttnttaacgtttctacgtactaaactaaggttaacgttaccggttaccgtacccccgtttaaggttccggtaccggtttccgggaccgggtaaacgggggtacccgtaaaggggtacgggtaaaggttaaaccgaaaacgggttaacgttgggttacggtacgtacggcccttaccgttacgttccgtggtttaacccttacctacctttacccgtttccccggttccgttaaccg

SEQ ID NO: 417990 - DNA, 654 bp, Homo sapiens
  misc_feature: GZ8MTXP01DY15H.2.25.C03.1.454.CMB.2.raw
  modified_base (202)..(202): a, c, t, g, unknown or other
  modified_base (240)..(240): a, c, t, g, unknown or other
  modified_base (374)..(374): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangcccacctctcctgcagggccagtcagagtgtaccggnacgtatgtagctggtaccagcagaacctggccaggctccagactctcatctcgtgggcatccagccgacgggccccgcactccccgagacgaggttcaggtggcgaggtcgggtcgtggggacaggtacgttcncgtctacaactaatcagcaagacgtggacgacgtaggtaagttagttttaggacgttagttagttaatttcgtagttacaaacctaattaacgttaccggttaaccgtaccccccgtttaggtcgggtaaccggtttccgggaccggtaacgggggtaacccgtaaaggggtacggtaaacggtaaccgtaaaacggttacgttacgggttacggtcgttacggacgttaccttagttcgttacgttcgttactacttaccgttccccgttccgtttaag

SEQ ID NO: 417991 - DNA, 619 bp, Homo sapiens
  misc_feature: GZ8MTXP01CGBET.2.25.C03.1.454.CMB.2.raw
  modified_base (201)..(201): a, c, t, g, unknown or other
  modified_base (241)..(241): a, c, t, g, unknown or other
  modified_base (331)..(331): a, c, t, g, unknown or other
  modified_base (604)..(604): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctcgaggggaaancgccacctctcctgcagggccagtcagagttcgtaccggntacgtatgtacgcctggtaccagcaacgaaacctggccaggcctaccagacctcctcatcctcgtgggcatccgagccgaccggccccgnacctccgagacgtaggttcaggtcggacgtacggttcggggtcgtaggggaacctaggtaacgtttcaactctaaaccgaacaacgtacgacgacgaacggtacgtggacgtacgtagtaagttatttagacgtagttgttattctagtaacaacgtaattacgtacgttaccgtaccccgttaggtcggtaccggttcggacgaacggggtactaagggtacgaaacgtaacgaaacgttagtgacgtactgacgcttattcgtatcttacncttcctccgcgtaac

SEQ ID NO: 417992 - DNA, 632 bp, Homo sapiens
  misc_feature: GZ8MTXP01BKLWS.2.25.C03.1.454.CMB.2.raw
  modified_base (199)..(199): a, c, t, g, unknown or other
  modified_base (237)..(237): a, c, t, g, unknown or other
  modified_base (400)..(400): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctccaggggaaangccacctctcctgcagggccagtcagagtgttaccggnacgtatgtagcctggtaccagcagaactggccaggctcccagctcctcatctcgtggggcatccaggccacggggcccccgcactccccagacaggttcaagtggctaggtggggtctggggacaggtaacgttcaactctcaacaagtcagcagactggacncgtagaagtatttgctaagttgtattcgtagtactaaactaagtacttacggtaccgtccccgtttagtcggtacggtttccggaccggtacggggtaccgaagggtacggtaaaggtaaccgaaaacggttacggttcggttacgggtaccttacgggacccgttaaccgttacttcccggttgtttccctttacgtaaccttcccgtttaaccccggttccgtttaaccg

SEQ ID NO: 417993 - DNA, 647 bp, Homo sapiens
  misc_feature: GZ8MTXP01AE14D.2.25.C03.1.454.CMB.2.raw
  modified_base (201)..(201): a, c, t, g, unknown or other
  modified_base (241)..(241): a, c, t, g, unknown or other
  modified_base (321)..(321): a, c, t, g, unknown or other
  modified_base (376)..(376): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccgaggggaaangcccaccctctcctgcagggccagtcagagtgttaccggnacgtatgtagcctggaccagcagaaacctggccaggctcccagacctcctcatctcgtgggcatccagcacgggccccgnactcccagacgaggttcagtggctaggtggggtctaggggaccaggtaacgttcnctctacaactatcgagcagactggacgcctaggaagtagttttcgacgtagttgttatttctagtactaaactaattacgtacggtacgtacccccgtttaaggtcggtaccggtttccggaccggaacgggggtaccgtaaacggggttacgggaaacggttaacgaaaacggttaaccgtgggttacggtacgttacgggcccttaaccgttacgttccgttaggttcccgtttacctaccttacccggtttccccgaacgtttaaccg

SEQ ID NO: 417994 - DNA, 662 bp, Homo sapiens
  misc_feature: GZ8MTXP01BMRQ2.2.25.C03.1.454.CMB.2.raw
  modified_base (199)..(199): a, c, t, g, unknown or other
  modified_base (238)..(238): a, c, t, g, unknown or other
  modified_base (286)..(286): a, c, t, g, unknown or other
  modified_base (318)..(318): a, c, t, g, unknown or other
  modified_base (374)..(374): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctccgaggggaangccaccctctcctgcagggccagtcagagtgttaccggnacgtatgtacgcctggtaccagcagaacctggccaggctccagctccncatctcgtgggcagtccagccgacggccccgnacgtccccgagacgagttcaggtggcaggtcgggtactggggacagtaacgttacncgtctacacaatcgagcgaagacgtggacgtcgtagtaagtagttttacgacttagttagttatttcgtataactaaactaaaggttacgttaccgttaaccgtacccccgtttaacggtacgggtaaccggttaccgggtaccgggaacgggtaacccggtaaaggggtacggtaaacggtaaccgtaaaaccggttaggtacgggttacgggactacgggttaccttacgttacttaaccgttggttaaccttacgtacttacccgttcccggttaacgttaaccg

SEQ ID NO: 417995 - DNA, 647 bp, Homo sapiens
  misc_feature: GZ8MTXP01D2VJC.2.25.C03.1.454.CMB.2.raw
  modified_base (201)..(201): a, c, t, g, unknown or other
  modified_base (389)..(389): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcaccctgtctttgtctccgaggggaaangccaccctctcctgcagggccagtcagagtgttaccggctacgtatgtagcctggaccagcagaaacctggaccaggcctcccagactcctcatcctcgtggggcatccagccgaacgggccccgcactccccgagactaggttcagtcggcgtaggtggggtacgtggggaactaggtaaacgttcncgttctaccaaacaactcgaagacgaacgtacgtcggtagccgtaggtaaagttattttacggactagttgttatttctagtaactaaactaattacgttcgttaaccgtacccccgtttaggtccggtacggttccggaaccggaacgggggtacctaaggggttacggaaacggttaacgaaaacgagtcggttacgcgtacggaccgaccttacgttcgttacgttcttactcttacccgttcccgttcttaacg

SEQ ID NO: 417996 - DNA, 531 bp, Homo sapiens
  misc_feature: GZ8MTXP02GIMKF.2.25.C03.1.454.CMB.2.raw
  modified_base (200)..(200): a, c, t, g, unknown or other
  modified_base (209)..(209): a, c, t, g, unknown or other
  modified_base (239)..(239): a, c, t, g, unknown or other
  modified_base (317)..(317): a, c, t, g, unknown or other
  modified_base (425)..(425): a, c, t, g, unknown or other
  modified_base (512)..(512): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctntcctgcagggccagtcagagtgttaccggnacgtatgtagcctggtaccagcagaaacctggccaggctccagactcctcatctctggggcatccagcacggccccgnactcccagacaggttcagtggcagtgggctggggacagagttcactctcacaatccaagcagactggagcctagaagtattttgctaagtgttaattctgttacaaanaatatcgtacgccccttaagtcgacgttcggccgaggggaccaagggtaggaagtacaaaacgaacgtgtaggctagcaccatcgtntcttcattcttccgactac

SEQ ID NO: 417997 - DNA, 531 bp, Homo sapiens
  misc_feature: GZ8MTXP02G1Y8G.2.25.C03.1.454.CMB.2.raw
  modified_base (200)..(200): a, c, t, g, unknown or other
  modified_base (319)..(319): a, c, t, g, unknown or other
  modified_base (360)..(360): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccacctctcctgcagggccagtcagagtgttaccggcacgtatgtagcctggtaccagcagaaacctggccaggctcccagactcctcatctctggggcatccagcacgggccccggnactcccagacaggttcagtggcaggtgggtctggggacagngttcactctcacaatcagcagactggacgcctagaagtattttgctagtgttatttctgtacaactaatactcgtacgtccccttagtcggacgttcggacgtacggggaccaagggtagaacgtacgaaaacgatacggtgctcgcacatctgtctcactcttccgctac

SEQ ID NO: 417998 - DNA, 531 bp, Homo sapiens
  misc_feature: GZ8MTXP02G4516.2.25.C03.1.454.CMB.2.raw
  modified_base (201)..(201): a, c, t, g, unknown or other
  modified_base (320)..(320): a, c, t, g, unknown or other
  modified_base (527)..(527): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggcacgtatgtagcctggtaccagcagaaacctggccaggctcccagactcctcatctctggggcatccagcagggcccccgnactcccagacaggttcagtggcagtgggtctgggacagagttcactctcacaatcagcagactggagcctgaatatttgctagtgtatttctgttacaactaatatcgtacgtccccttaagtcggacgttcggccgaaggggaccaagggtgaacgtacgaaaacgaactggtcggactcgacaccatctgtcttcatccgttccnctac

SEQ ID NO: 417999 - DNA, 599 bp, Homo sapiens
  misc_feature: GZ8MTXP02GV74B.2.25.C03.1.454.CMB.2.raw
  modified_base (201)..(201): a, c, t, g, unknown or other
  modified_base (240)..(240): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaacctggccaggctcccagacctcctcatctcgtgggcatccagcgaccgggccccgcactcccagacaggtcagtggcaggtgggtcgtgggacagtagttcactctacacaatcagcagacgtggacgccgtagaagttagtttgactagttgttatttctagtacaaactaattacgtacgtaccgtaccccgttagtcggtaccgttaccgggaccgaacggggaaccgtaagggtacggaaacgttaaccgaaaacggtacgtacggtcggacgtacgacctacctagttccgtcgttaccgttactacttccgttaccccgtacttacg

SEQ ID NO: 418000 - DNA, 582 bp, Homo sapiens
  misc_feature: GZ8MTXP02IVCE6.2.25.C03.1.454.CMB.2.raw
  modified_base (241)..(241): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaagagccaccctctcctgcagggccagtcagagtgttaccggnacgtatgtagcctggtaccagcagaaacctggccaggctccagactcctcatctctggggcatccagcacggccccggcatcccagacaggttcagtggcagtgggtctgggacagagttcactctcacatcagcagactggagcctgaagtattttgctagtgttattctgtacaaactaatattcgtacgtccccgtttagtcggtacgttcggccgaacgggggaccaagggtacggaaacgttacgaaaacggtaacgtacggtacggcttacgaccgaccctaagttcgttcggttacctttacctaacgtttccctttacccggacccttaaccg

SEQ ID NO: 418001 - DNA, 534 bp, Homo sapiens
  misc_feature: GZ8MTXP02GPCB3.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctccagactcctcatctctggggcatccagcgaggcccccggcactcccagacaggttcagtggcagtgggtctgggacagagttcactctcacaatcagcagactggagcctagaatatttgctagtgtatttctgtacaaactaatattcgtagtcccccgttagtcggacgtttcggcgaacgggggacctaagggtaggaagtacgaaaacggaactggtggcgtgacacatcgtgtcttcatcttcccgctac

SEQ ID NO: 418002 - DNA, 623 bp, Homo sapiens
  misc_feature: GZ8MTXP02HG5KD.2.25.C03.1.454.CMB.2.raw
  modified_base (201)..(201): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggcacgtatgtagcctggtaccagcagaaacctggccaggctccagactcctcatctctggggcatccagcagggcccccggcatcccagacaggttcagtggcagtgggtctggggacagagttcactctcacaatcagcagactggagcctgaagtattttgctagtgttatttctgttacaaactaatattaccgtacgtccccctttaacgtcggtaaccggtttccgggccgtaacggggggaaccctaagggggttacgggaaaacggttaccgaaaaacggtaaaccgttgggttacgggccgttacgggaccgaaacccgtaactccgttacggttacctttccgaaccgtttacctttcccccggacccttaaccg

SEQ ID NO: 418003 - DNA, 530 bp, Homo sapiens
  misc_feature: GZ8MTXP02GMR1M.2.25.C03.1.454.CMB.2.raw
  modified_base (201)..(201): a, c, t, g, unknown or other
  modified_base (240)..(240): a, c, t, g, unknown or other
  modified_base (321)..(321): a, c, t, g, unknown or other
  modified_base (415)..(415): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggccaggctcccagactcctcatctctggggcatccagcagggcccccggnactcccagacaggttcagtggcagtgggtctggggacagagttcactctcacatcagcagactggagcctagaagattttgctagtgtatttcngttacaacaatatcgtacgccccttaggtcgacgttcggcgtaggggaccagggtcgaagtacgaaaacgaactgtcggctacgacacctatcgtgtcttacactctcccgctac

SEQ ID NO: 418004 - DNA, 626 bp, Homo sapiens
  misc_feature: GZ8MTXP02HW0A7.2.25.C03.1.454.CMB.2.raw
  modified_base (201)..(201): a, c, t, g, unknown or other
  modified_base (240)..(240): a, c, t, g, unknown or other
  modified_base (288)..(288): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcaccctgtctttgtctccgaggggaaangccacctctcctgcagggccagtcagagttgttaccggnacgtatgtagcctggaccagcagaaacctggccaggctccagactccncactctcgtggggcatccagccgacgggcccccgcactcccagacaggtcagtggcaggtgggtctggggacagacgttcactctacacaatcagcagacgtaggacgtcctaggaagttacgttttgacgtagttgttaatttctagttaacaaacgtaaattaacgttacgtaaccgttacccccgtttacggtacgggtaaccggtttaccgggaccggaacgggggaaccgtaaaggggtacggaaacggttaaccgaaaacggtacgtacggtcggactacggactaaccctagtaaccttcgttaccttctactttcccttacccgtactac

SEQ ID NO: 418005 - DNA, 525 bp, Homo sapiens
  misc_feature: GZ8MTXP02JYK8Z.2.25.C03.1.454.CMB.2.raw
  modified_base (201)..(201): a, c, t, g, unknown or other
  modified_base (241)..(241): a, c, t, g, unknown or other
  modified_base (322)..(322): a, c, t, g, unknown or other
  modified_base (389)..(389): a, c, t, g, unknown or other
  modified_base (440)..(440): a, c, t, g, unknown or other
  modified_base (490)..(490): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctcccagactcctcatctctggggcatccagcagggcccccggnatcccagacaggttcagtggcagtgggtctggggacagagttcactctcacaatcagcagactgganccgtagaagtattttgctagttgtatttctgtacaaacaaattatcgtacncccccttaagtcggacgttcggcgaggggaccaggtgaagtacaaagacnggtgctcgcaccgatctgtcttcatcttcccgcta

SEQ ID NO: 418006 - DNA, 538 bp, Homo sapiens
  misc_feature: GZ8MTXP02G67EW.2.25.C03.1.454.CMB.2.raw
  modified_base (201)..(201): a, c, t, g, unknown or other
  modified_base (210)..(210): a, c, t, g, unknown or other
  modified_base (240)..(240): a, c, t, g, unknown or other
  modified_base (320)..(320): a, c, t, g, unknown or other
  modified_base (390)..(390): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctntcctgcagggccagtcagagtgttaccggnacgtatgtagcctggtaccagcagaaacctggccaggctcccagactcctcatctctgggcatccagcacgggcccccgnactcccagacaggttcaatggcaggtgggtctggggacagtagttcactctcacaatcagcagactggancctgaagtatttgctagtgtatttcagtacaaactaatatcgtacgtccccttagtcgtacgttcggcctagggggaccaagggtggaacgttacgaaaacgtacgtcgtaggctacgacaccatctgtcttactactccttccgcta

SEQ ID NO: 418007 - DNA, 528 bp, Homo sapiens
  misc_feature: GZ8MTXP02HD1NV.2.25.C03.1.454.CMB.2.raw
  modified_base (200)..(200): a, c, t, g, unknown or other
  modified_base (318)..(318): a, c, t, g, unknown or other
tcagacgctcgacacacgaccggtgctcgatttagtagtgtagatttgggtttggggagagctgctcagttaggacccagagggaaccatggaaacccagcgcagcttctcttcctcctgctactctggctcccagataccaccggagagattgtgttgacgcagtctccaggcaccctgtctttgtctccaggggaaangccacctctcctgcagggccagtcagagtgttaccggcacgtatgtagcctggtaccagcagaaacctggccaggctcccagactcctcatctctggggcatccagcagggcccccgnatcccagacaggttcagtggcagtgggtctggggacagagttcactctcacaatcagcagactggagctgaagattttgctagtgtatttctgttcaaactaatattcgtagtcccccttagtcggacgtttcgggccaagggggaccaagggtggaaagttacgaaaacgaactcgtaggctgcacatctgtcttcatccttccgctac

SEQ ID NO: 418008 - DNA, 528 bp, Homo sapiens
  misc_feature: GZ8MTXP02GRMXM.2.25.C03.1.454.CMB.2.raw
  modified_base (200)..(200): a, c, t, g, unknown or other
  modified_base (209)..(209): a, c, t, g, unknown or other
  modified_base (239)..(239): a, c, t, g, unknown or other
  modified_base (409)..(409): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcaccctgtctttgtctccaggggaaanagccacctntcctgcagggccagtcagagtgttaccggnacgtatgtagcctggtaccagcagaaacctggcaggctccagactcctcatctctggggcatccagcaggcccccggcatcccagacaggttcagtggcagtggtctgggacagagttcactctcacaatcaagcagactggagcctgaagattttgcaagtgtatttcngttacaaacaaatatcgtacgccccttaagtggacgttcggccgaggggaccaaggtgaaagtcaaaacgaactagtggctgacaccaatcgtcgtcttacacttctcccgtcctaacg

SEQ ID NO: 418009 - DNA, 590 bp, Homo sapiens
  misc_feature: GZ8MTXP02GDB2Y.2.25.C03.1.454.CMB.2.raw
  modified_base (199)..(199): a, c, t, g, unknown or other
  modified_base (236)..(236): a, c, t, g, unknown or other
  modified_base (389)..(389): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctcaggggaaangccacctctcctgcagggccagtcagagtgtaccggnacgtatgtagcctggtaccagcagaacctggccaggctccagactcctcatctcgtggggcatccagcgacgggcccccgcactcccagacaggttcagtggcaggtgggtcctgggacagacgttcactctcaacaatcagcagactggacncgtagaagtatttgctagtgttattcgtgtacaaactaatacttcgtacgtaccccgttagtacggtacgttcgggaccgaacggggaaccgtaaaggggtacggtaaacgtaacgaaaacggtaacgttggtacggtacgtacgacctaacctaacttccgttacggttccttacctacttcccgttaccccgcctaacg

SEQ ID NO: 418010 - DNA, 591 bp, Homo sapiens
  misc_feature: GZ8MTXP02H9YCZ.2.25.C03.1.454.CMB.2.raw
  modified_base (201)..(201): a, c, t, g, unknown or other
  modified_base (405)..(405): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggcacgtatgtagcctggtaccagcagaaacctggccaggctcccagactcctcatctctggggcatccagcacgggcccccggcactcccagacaggttcagtggcagtgggtctggggacagagttcacgtctcacaatcagcagactggagctagaagtattttgntagtgtatttctgtacaaactaatatcgtacgtccccttaagtcggtacgttcggaccgacggggtaccaaggggtcggaaaacggttacgaaaacggtaaccgttaggttacggacgttacggacctaaccacttaaccgttggttaccttttacgtaactttcccgtttccccggtacctaacg

SEQ ID NO: 418011 - DNA, 523 bp, Homo sapiens
  misc_feature: GZ8MTXP02JFWZ0.2.25.C03.1.454.CMB.2.raw
  modified_base (200)..(200): a, c, t, g, unknown or other
  modified_base (321)..(321): a, c, t, g, unknown or other
  modified_base (358)..(358): a, c, t, g, unknown or other
  modified_base (433)..(433): a, c, t, g, unknown or other
tcagacgctcgacacacgaccggtgctcgatttagtagtgtagatttgggtttgggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccacctctcctgcagggccagtcagagtgttaccggcacgtatgtagcctggtaccagcagaaacctggccaggctcccagacctcctcatctctggggcatccagcacgggcccccgnactcccagcaggttcagtggcagtgggtctggggacngagttcactctcacaatccaagcagactggagcctgaagtattttgcagttgtatttctgtacaacatatcgtanccccttagtgacgttcggcgagggaccaaggtggaagtacaaaacggactggtaggctcggacaccatctagtctcatccttcccgctac

SEQ ID NO: 418012 - DNA, 635 bp, Homo sapiens
  misc_feature: GZ8MTXP02HAZ1J.2.25.C03.1.454.CMB.2.raw
  modified_base (200)..(200): a, c, t, g, unknown or other
  modified_base (238)..(238): a, c, t, g, unknown or other
  modified_base (323)..(323): a, c, t, g, unknown or other
  modified_base (335)..(335): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctccaggggaaangccacctctcctgcagggccagtcagagtgttaccggnacgtatgtacgcctggtaccagcaacgaaacctggccaggcctcccagactcctcatctcgtgggcatccagcgacgggccccgnactcccgagacnggttcagtggcaggtggtcgtggggacaggtagttcacgtctacactaatcaagcaagacgtggacgtcgtaggtaagtagttttgactagttagttatttcgtacgttacaaactaagttacgtcggttaaccgttaccccgtttacgggtacgtaaccgggtttccgggaccggtaacgggggtaacccgtaaaggggtcggtaaaacggttaaccgaaaacggtaccgttagggtacggtacgtacggacctaccgtactcgtttcgtaccttcgtactttcccgttacccgctacg

SEQ ID NO: 418013 - DNA, 542 bp, Homo sapiens
  misc_feature: GZ8MTXP02J16E7.2.25.C03.1.454.CMB.2.raw
  modified_base (200)..(200): a, c, t, g, unknown or other
  modified_base (319)..(319): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctctcctgcagggccagtcagagtgttaccggcacgtatgtagcctggtaccagcagaaacctggccaggctcccagactcctcatctctggggcatccagcagggcccccgnactcccagacaggttcagtggcagtgggtctggggacagagttcactctcacaatcagcagactggagcctgaagtatttgctagttgttatttctgttacaaactaatatcgtacgtcccccgttaggtcgtacgttcggacgacggggaccaagggtgaacgtacgaaaacgaatcggtacggctcgacacgtatcgtcgtcttcacttcctccgtctacg

SEQ ID NO: 418014 - DNA, 549 bp, Homo sapiens
  misc_feature: GZ8MTXP02G2JU8.2.25.C03.1.454.CMB.2.raw
  modified_base (201)..(201): a, c, t, g, unknown or other
  modified_base (211)..(211): a, c, t, g, unknown or other
  modified_base (241)..(241): a, c, t, g, unknown or other
  modified_base (321)..(321): a, c, t, g, unknown or other
  modified_base (390)..(390): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctntcctgcagggccagtcagagtgttaccggnacgtatgtagcctggtaccagcagaaacctggccaggctcccagactcctcatctctgggcatccagcacggcccccggnactcccagacaggttcagtggcagtgggtctggggacagtagttcactctcacaatcagcagactggancctgaagtatttgctagtgttatttctgtacaaacgtaatatcgtacgtccccttagtggtaccgttcggccgaaggggacctaagggtaggaagtacgaaaacgtatacggtcggtactcgaccacgtatcgtgtacttcacttccttacccgctacg

SEQ ID NO: 418015 - DNA, 562 bp, Homo sapiens
  misc_feature: GZ8MTXP02HQCDD.2.25.C03.1.454.CMB.2.raw
  modified_base (201)..(201): a, c, t, g, unknown or other
  modified_base (241)..(241): a, c, t, g, unknown or other
  modified_base (321)..(321): a, c, t, g, unknown or other
  modified_base (389)..(389): a, c, t, g, unknown or other
tcagacgctcgacacacgaccggtgctcgatttagtagtgtagatttgggtttggggagagctgctcagttaggacccaaagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctccagactcctcatctctgggcatccagcacgggcccccggnactcccagacaggttcagtggcagtcgggtctggggacagagttcactctcacaatcagcagactganctagaagtatttgctagtgttattctagtactaaactaatacttcgttaacgtccccctttaaggtcggtacgttcggaccgtaacgggggaccgaaaggttcgggaaagtacgaaaacgtacgtaggtcgcgtacgacaccatctaagtcttcactccgttccacctatccg

SEQ ID NO: 418016 - DNA, 514 bp, Homo sapiens
  misc_feature: GZ8MTXP02IXTQ7.2.25.C03.1.454.CMB.2.raw
  modified_base (201)..(201): a, c, t, g, unknown or other
  modified_base (365)..(365): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccacctctcctgcagggccagtcagagtgttaccggcacgtatgtagcctggtaccagcagaaacctggccaggctcccagactcctcatctctggggcatccagcagggcccccggcatccccagacaggttcagtggcagtgggtctgggacagagttcnctctcacaatcagcagactggagcctgaagattttgctagtgtattctgtcaacatatcgtacgccccttacgtgacgttcggcaggggaccaaggtggaagtacgaaacgactgtaggctgcaccatctgtcttcatccttccgctac

SEQ ID NO: 418017 - DNA, 577 bp, Homo sapiens
  misc_feature: GZ8MTXP02I8IUO.2.25.C03.1.454.CMB.2.raw
  modified_base (201)..(201): a, c, t, g, unknown or other
  modified_base (240)..(240): a, c, t, g, unknown or other
  modified_base (250)..(250): a, c, t, g, unknown or other
  modified_base (365)..(365): a, c, t, g, unknown or other
  modified_base (387)..(387): a, c, t, g, unknown or other
  modified_base (395)..(395): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggatagattgtgttgacgcagtctccaggcaccctgtctttgtctccaggggaaangccaccctctcctgcagggccagtcagagtgttaccggnacgtatgtancctggtaccagcagaaacctggccaggctcccagactcctcatctctggggcatccagcagggcccccggcactcccagacaggttcagtggcagtgggtctgggacagagttcnctctcacatcagcagactggancctgaagntttgcagtgtattctgtacaactaatattcgtacgtccccttagtcggtacgtttcggaccgtacggggaccctaaagggtcggaaagttacgaaaacggaaaccgtggtacggaccttacgggacctaaccggtaactcgttacggtccgtttacaactttccctttcccggacctaaccg

SEQ ID NO: 418018 - DNA, 588 bp, Homo sapiens
  misc_feature: GZ8MTXP02JZ2X2.2.25.C03.1.454.CMB.2.raw
  modified_base (202)..(202): a, c, t, g, unknown or other
  modified_base (242)..(242): a, c, t, g, unknown or other
  modified_base (375)..(375): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaanagccaccctctcctgcagggccagtcagagtgttaccggnacgtatgtagcctggtaccagcagaaacctggccaggctcccagacctcctcatctcgtggggcactccagccgacggggcccccgcactcccagacaggttcagtggcaggtgggtctgggacaggagttcncgtctcacatcagcagactggagcctaggaacgtagtttgctagttgttaatttctgttacaaactaattactacgtaccgtcccccgtttagtcggtaccggtttacggaccgtaacgggggacctaagggtacggaagtacaaaacggtacgtcgtagggctacgccgtaaccagttcgtcggtaccttctacgtccgttcccgacttacg

SEQ ID NO: 418019 - DNA, 536 bp, Homo sapiens
  misc_feature: GZ8MTXP02HT4HJ.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctctggggcatccagcacggccccgcactcccagacaggtcagtggcagtgggtctgggacagagttcactctcacaatcagcagactgagctagagtattttgctagtgtatttctgtactaaactaaatattacgtacgtaccccgttacgtcggtaccgttcggccgaggggaccaagggtacggaagtacgaaaacgaactggtcgactcgactacatctgtcttcattacctccgctac

SEQ ID NO: 418020 - DNA, 615 bp, Homo sapiens
  misc_feature: GZ8MTXP02H0Z28.2.25.C03.1.454.CMB.2.raw
  modified_base (201)..(201): a, c, t, g, unknown or other
  modified_base (240)..(240): a, c, t, g, unknown or other
  modified_base (321)..(321): a, c, t, g, unknown or other
  modified_base (368)..(368): a, c, t, g, unknown or other
  modified_base (390)..(390): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccacctctcctgcagggccagtcagagtgttaccggnacgtatgtagcctggtaccagcagaaacctggccaggctcccagacctcctcatctctgggcatccagcacgggcccccgnactcccagacaggttcaggtggcagtgggtctggggacagacgttcnctctcacatcagcagactgganctgaagtgttttgctagttgtatttctagtactaaactaatattacgtacgtcccccgttaacgtcggtacgtttcgggaccgagggggaaccctaaagggggttacggaaaacggttaccgaaaaacgggtaaaccgttggttacggggaccttacgggaccaacccgtaacttcccgttggttacctttccgtaagtttccccttttccccggacccttaacg

SEQ ID NO: 418021 - DNA, 574 bp, Homo sapiens
  misc_feature: GZ8MTXP02G7H9K.2.25.C03.1.454.CMB.2.raw
  modified_base (202)..(202): a, c, t, g, unknown or other
  modified_base (242)..(242): a, c, t, g, unknown or other
  modified_base (323)..(323): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagatttgtgttgacgcagtctccaggcaccctgtctttgtctccaggggaaanagccaccctctcctgcagggccagtcagagtgttaccggnacgtatgtagcctggtaccagcagaaacctggccaggctcccagactcctcatctctggggcatccagcacgggccccggnactcccagacaggttcagtggcaggtgggctgggacaggagttcacgtctacacaatcaagcagactggagcctagaagtattttgctagttgttattctagtacaactaatatcgtacgtaccccgttacgtacggtacgttcggccgaagggggaccgaagggtgggaaaacggttacgaaaacggtaacgtggttggccgtaggccaaccgatccgtgttaccttactacgtcctttcccgaccctac

SEQ ID NO: 418022 - DNA, 527 bp, Homo sapiens
  misc_feature: GZ8MTXP02IBRGL.2.25.C03.1.454.CMB.2.raw
  modified_base (201)..(201): a, c, t, g, unknown or other
  modified_base (241)..(241): a, c, t, g, unknown or other
tcagacgctcgacacacgaccggtgctcgatttagtagtgtagatttgggtttggggagagctgctcagttaggacccagagggaactatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctcccagactcctcatctctggggcatccagcagggcccccgcatcccagacaggttcaatggcagtggggtctggggacagagttcactctcacaatcagcagactggagcctgaagatttttgactagtgtatttctgtacaacatatcgtagtcccccttagtcgtacgttcggcgacggggaccaagggtggaaagtacaaacgactcgtggctgcacgatcgtgtcttcattccttccgactac

SEQ ID NO: 418023 - DNA, 532 bp, Homo sapiens
  misc_feature: GZ8MTXP02JX4ON.2.25.C03.1.454.CMB.2.raw
  modified_base (201)..(201): a, c, t, g, unknown or other
  modified_base (239)..(239): a, c, t, g, unknown or other
  modified_base (364)..(364): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctccagactcctcatctctggggcatccagcagggcccccgcactcccagacaggttcagtggcaggtgggtctggggacagagttcnctctcacaatcagcagactggagcctagaagtatttgctagttgtattctgtacaactaatactcgtacgccccttagtggtaccgttcggaccgacggggaccagggtagaaggtacgaaaacgactggtggctacgcaccgatcgtgtcttcactcttcccgctac

SEQ ID NO: 418024 - DNA, 552 bp, Homo sapiens
  misc_feature: GZ8MTXP02FU86M.2.25.C03.1.454.CMB.2.raw
  modified_base (201)..(201): a, c, t, g, unknown or other
  modified_base (239)..(239): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctccagactcctcatctctggggcatccagcacgggcccccgcactcccagacaggttcagtggcagtgggtctggggacagagttcactctcacaatcagcagactggagcctagaagtattttgctaagttgttatttctgttacaaactaatatcgtacgtaccccttagtcggacgttcggacgtaggggaccaagggtaggaagtacgaaaacgactaggtaggtacgtcgacacctaagtcttacgtacttcacttccttcccgactacg

SEQ ID NO: 418025 - DNA, 521 bp, Homo sapiens
  misc_feature: GZ8MTXP02FF5K3.2.25.C03.1.454.CMB.2.raw
  modified_base (199)..(199): a, c, t, g, unknown or other
  modified_base (238)..(238): a, c, t, g, unknown or other
tcagacgctcgacacacgaccggtgctcgatttagtagtgtagatttgggtttgggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctctcctgcagggccagtcagagtgttaccggnacgtatgtagcctggtaccagcagaaacctggccaggctcccagactcctcatctctggggcatccagcagggcccccggcatcccagacaggttcagtggcagtgggtctgggacagagttcactctcacaatcagcagactggagcctgaagattttgcagtgtatttctgtacaacaaatatcgtagtacccccttagtcgacgttcggccgaggggaccaaggtggaaagtacaaaacgaactagtaggctgcaccatctgtcttcatcttcccgctac

SEQ ID NO: 418026 - DNA, 637 bp, Homo sapiens
  misc_feature: GZ8MTXP02H5FZ7.2.25.C03.1.454.CMB.2.raw
  modified_base (201)..(201): a, c, t, g, unknown or other
  modified_base (239)..(239): a, c, t, g, unknown or other
  modified_base (318)..(318): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgtaccggnacgtatgtagcctggtaccagcagaaacctggcaggctccagactctcatctcgtgggcatccagcgacgggcccccgnaactcccagacaggttcagtggcaggtgggtctggggacaggtagttcactctacactaatcaggcaagactggagtccgtaggaagtacgttttgacgtagttagtattttacgtagttactaaactaattagttacgttaaccgtacccctttacggtacgtaaccggttcgggacccgtaacgggggaaccgtaaaggggtacgggaaacggttaacgaaaaccggtaacgtacggtacgggacgtacggaccaaccgtaacgttccgttacggttaccttaccgtaactttccccgtttaccccgacccgtaacg

SEQ ID NO: 418027 - DNA, 580 bp, Homo sapiens
  misc_feature: GZ8MTXP02ILSGR.2.25.C03.1.454.CMB.2.raw
  modified_base (199)..(199): a, c, t, g, unknown or other
  modified_base (317)..(317): a, c, t, g, unknown or other
  modified_base (362)..(362): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctcaggggaaangccacctctcctgcagggccagtcagagtgttaccggcacgtatgtagcctggtaccagcagaaacctggccaggctccagactcctcatctctggggcatccagccacgggccccgnactcccagacaggttcagtgcaggtgggtctgggacagtagttcnctcacaacaatcagcagactggagcgtagaatagtttgctagttgttatttctgtaactaaactaatacgttaccgtacgtaccccgtttacggtcggtacggttacgggaccggaacgggggtacctaaaggggtacggaacgtaacgaaaacgtaacgtacggtacggacgtcgacgaactagtcgtcgttcttacgtacttcctaccgtactacg

SEQ ID NO: 418028 - DNA, 651 bp, Homo sapiens
  misc_feature: GZ8MTXP02G7MEG.2.25.C03.1.454.CMB.2.raw
  modified_base (199)..(199): a, c, t, g, unknown or other
  modified_base (237)..(237): a, c, t, g, unknown or other
  modified_base (320)..(320): a, c, t, g, unknown or other
  modified_base (373)..(373): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcacctgtctttgtctcgaggggaaangccacctctcctgcagggccagtcagagtgttaccggnacgtatgtagcctggtaccagcagaaacctggccaggctcccagacctcctcatctcgtggggcatccatcgacggcccccgnactcccagacaggttcagtggcaggtgggtctggggacaggagttcactctanacaatcagcaagacgtggacgtcctaggaagtaagttttgactaggttacgttaatttcgtagttacctaaaactaaagttaacgttacgtaaccgtacccccgtttaaggtcggtaaccggtttcgggaccggtaacgggggaaccgtaaaggggttacggaaaacgttacgaaaacggtaacgtacggtacggaccgttacggaccctaaccgtacgttaaccgttacggtttccctttacgtaaccgtttccctttaccccggtacccttaaccg

SEQ ID NO: 418029 - DNA, 632 bp, Homo sapiens
  misc_feature: GZ8MTXP02H5FXW.2.25.C03.1.454.CMB.2.raw
  modified_base (201)..(201): a, c, t, g, unknown or other
  modified_base (240)..(240): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggaccagcagaaacctggccaggctcccagactcctcatctctggggcatccagcacggcccccgcactcccagacaggttcaggtggcacggtgggtcgtggggacaggacgttcactcgtacacaatcaggcagacctggacgcccgtagaagtagtttttgacgtagttgtaactttctagtacaaactaatattaccgtacgtccccgttacggtcggtaccggttaccggaccggtaacggggtaacccgaaggggttacgggaaacggttaccgaaaaccggtaccgtagggtacggaccgttacgaccgtaacctaacgttcttacggttacctttaccgactttaccccgttaccccggtacccttaaccg

SEQ ID NO: 418030 - DNA, 549 bp, Homo sapiens
  misc_feature: GZ8MTXP02GVNWG.2.25.C03.1.454.CMB.2.raw
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaagagccaccctctcctgcagggccagtcagagtgttaccggcacgtatgtagcctggtaccagcagaaacctggccaggctcccagactcctcatctctggggcatccagcgacggcccccggcactcccagacaggttcagtggcagtgggtctggggacagagttcactctcacaatcagcagactggagctagaagtatttgcgtagtgttattctgtacaataaccccctatcgtacgtcccctacgtcgtacgttcggcgacgggaccgaggtaggaacgtacgaaacgacgtacgtaggcgtacgcaccgatcgtcgtacttcgtactttcccgtcctacttcg

SEQ ID NO: 418031 - DNA, 611 bp, Homo sapiens
  misc_feature: GZ8MTXP02H3WQ2.2.25.C03.1.454.CMB.2.raw
  modified_base (201)..(201): a, c, t, g, unknown or other
  modified_base (318)..(318): a, c, t, g, unknown or other
  modified_base (369)..(369): a, c, t, g, unknown or other
  modified_base (394)..(394): a, c, t, g, unknown or other
  modified_base (405)..(405): a, c, t, g, unknown or other
  modified_base (420)..(420): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcaggccagtcagagtgttaccgcacgtatgagcctggtaccagcagaacctggccaggctcccagactcctcatctcgtgggcactccagcgacgggccccgnactcccagacaggttcaggtggctaggtgggtctggggacagtacgtttcnctctacacaatcagcagacgtggancgtagaaagtnttttggctaggtttnttactttcgtacgtaactaaactaacttacgttaccgtacccgtaccccgttacggtcggtaccggttcggacgggtaacggggaaccgtaaggggtacggtaaacgtaacgaaaacggtacgtacggtacggctacgacctaaccgtagtccgttacgttacttactaccgttcccgttacccgtactac

SEQ ID NO: 418032 - DNA, 524 bp, Homo sapiens
  misc_feature: GZ8MTXP02IL2U3.2.25.C03.1.454.CMB.2.raw
  modified_base (201)..(201): a, c, t, g, unknown or other
  modified_base (360)..(360): a, c, t, g, unknown or other
  modified_base (376)..(376): a, c, t, g, unknown or other
  modified_base (380)..(380): a, c, t, g, unknown or other
  modified_base (404)..(404): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccacctctcctgcagggccagtcagagtgttaccggcacgtatgtagcctggtaccagcagaactgcaggctccagactcctcatctctggggcatccagcacggccccggcactcccagacaggttcagtggcagtgggtctggggacagagttcnctctcacaatcagcanctgngctgaatatttgcagtgttattcngtacaaacaaatactcgtacgtccccgttagtcggtacgttcggccgaggggaccaagggtaggaagtacgaaaacgacgtgtggactcgacaccatcgtcgtctcattcctccgactac

SEQ ID NO: 418033 - DNA, 528 bp, Homo sapiens
  misc_feature: GZ8MTXP02HA4J4.2.25.C03.1.454.CMB.2.raw
  modified_base (200)..(200): a, c, t, g, unknown or other
  modified_base (209)..(209): a, c, t, g, unknown or other
  modified_base (239)..(239): a, c, t, g, unknown or other
  modified_base (525)..(525): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctntcctgcagggccagtcagagtgttaccggnacgtatgtagcctggaccagcagaaacctggccaggctcccagactcctcatctctggggcatccagcacgggccccggcactcccagacaggttcagtggcagtgggtctgggacagagttcactctcacaatcagcagactggagcctgaagtattttgctagtgtatttctgttacaaacaatactcgtagcccccttagtcggtacgttcggcgacggggaccaaggtggaaagtacaaaacgaaacttgaggctcgacaccaatctgtctcatcttccccnctc

SEQ ID NO: 418034 - DNA, 591 bp, Homo sapiens
  misc_feature: GZ8MTXP02H52X5.2.25.C03.1.454.CMB.2.raw
  modified_base (202)..(202): a, c, t, g, unknown or other
  modified_base (241)..(241): a, c, t, g, unknown or other
  modified_base (375)..(375): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaagngccaccctctcctgcagggccagtcagagtgttaccggnacgtatgtagcctggtaccagcagaaacctggccaggctcccagactcctcatctcgtggggcatccagccgacggggcccccggcactcccagacaggttcaagtggcagtggggtctggggacaggagttcncgtctcacaatcagcagactggacgccgtagaagtatttttgactagttagttatttctagtacaaactaattattcgtacgtcccctttaggtcggtaccggttcggtccgacggggtaaccgtaagggtacggaaacgtacgaaaacggtaacgtacggtcggacttcggacaccgtattcgtcgttcttctacttcccgttcccgtacctacg

SEQ ID NO: 418035 - DNA, 602 bp, Homo sapiens
  misc_feature: GZ8MTXP02IWYEF.2.25.C03.1.454.CMB.2.raw
  modified_base (201)..(201): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccacctctcctgcagggccagtcagagtgttaccggcacgtatgtagcctggtaccagcagaaacctggccaggctcccagactcctcatctcgtgggcatccagccgacgggcccccggcactccccagacaggttcaaagtggcaggtgggtctgggacagagttcactctacacaatcagcagactggagctggaagtattttgctagttagtattctagtacaaactaatagttacgttaccgtcccccgttaacggtcggttacggttaccgggccgaaacgggggtaccgtaaaggggtaggtaaacgtaacggaaaacgtaaacgttcggtacggacgtcgaccgtaacctagtccgttcgtaccttacactttcccgttacccgtccctac

SEQ ID NO: 418036 - DNA, 552 bp, Homo sapiens
  misc_feature: GZ8MTXP02I4W2C.2.25.C03.1.454.CMB.2.raw
  modified_base (201)..(201): a, c, t, g, unknown or other
  modified_base (260)..(260): a, c, t, g, unknown or other
  modified_base (358)..(358): a, c, t, g, unknown or other
  modified_base (389)..(389): a, c, t, g, unknown or other
  modified_base (399)..(399): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggcacgtatgtagcctggtaccngcagaaacctggccaggctcccagactcctcatctctggggcatccagcagggcccccgcactcccagacaggttcagtggcagtgggtctggggacngacgttcactctcacaatcagcagactgganccgtgaagtnttttgctagttgtatttctgtacaactaagtattcgtacgtccccttagtcggtacgttcggcgaggggaccgtaagggtacggtaacgtacgaaaacggtaactggtacggactacggaccaccatcgtacgtctctactccttaccgctac

SEQ ID NO: 418037 - DNA, 648 bp, Homo sapiens
  misc_feature: GZ8MTXP02HEW2C.2.25.C03.1.454.CMB.2.raw
  modified_base (201)..(201): a, c, t, g, unknown or other
  modified_base (209)..(209): a, c, t, g, unknown or other
  modified_base (239)..(239): a, c, t, g, unknown or other
  modified_base (366)..(366): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctntcctgcagggccagtcagagtgttaccggnacgtatgtagcctggtaccagcagaaacctggccaggctcccagactcctcatctctggggcatccagcgacgggcccccggcactcccagacaggttcagtggcagtgggtctgggacagagttcncgtctcacatcagcagactggagcctagaagtacttttgctagtgttaatttcgtagtactaaactaattacgttacgtaccgtacccccgtttaacggtacgggtaccggtttacgggaccggtaacgggggtaacccgtaaaggggttacgggaaaacggttaaccggtaaaaccgggtaaaccgttagggtaaacgggtccgttacgggacctaaccgtaacgttccgttacgggttccctttacgaactttcccgtttaccccggtcccgtttaaccg

SEQ ID NO: 418038 - DNA, 553 bp, Homo sapiens
  misc_feature: GZ8MTXP02FJFJM.2.25.C03.1.454.CMB.2.raw
  modified_base (201)..(201): a, c, t, g, unknown or other
  modified_base (241)..(241): a, c, t, g, unknown or other
  modified_base (367)..(367): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctcccagactcctcatctctggggcatccagcagggcccccggcactccccagacaggttcagtggcagtgggtctgggacagagttcnctctcacaatcagcagactggagcctgaagtatttgctagtgtatttctgtacaaacaattatcgtacgtacccccttagtcggtaccgttcggccgtaaggggacccaaagggtaggaaagtacgaaaacggaactcggtaggctacgccaccgatccgtgtctttacgattccttcccgctacg

SEQ ID NO: 418039 - DNA, 532 bp, Homo sapiens
  misc_feature: GZ8MTXP02FGVES.2.25.C03.1.454.CMB.2.raw
  modified_base (200)..(200): a, c, t, g, unknown or other
  modified_base (209)..(209): a, c, t, g, unknown or other
  modified_base (238)..(238): a, c, t, g, unknown or other
  modified_base (248)..(248): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccaccctntcctgcagggccagtcagagtgtaccggnacgtatgtancctggtaccagcagaaacctggccaggctcccagactcctcatctctggggcatccagcagggcccccggcatcccagacaggttcagtggcagtgggtctgggacagagttcactctcacaatcagcagactggagcctagaagattttgctagtgtatttctgtacaactaatatcgtagtcccccttagtcggtacgttcggccgacggggaccgaagggtaggaaagtacgaaaacgacgtgtaggctacgccacataactgtactcactctcccgctac

SEQ ID NO: 418040 - DNA, 637 bp, Homo sapiens
  misc_feature: GZ8MTXP02IES8M.2.25.C03.1.454.CMB.2.raw
  modified_base (201)..(201): a, c, t, g, unknown or other
  modified_base (240)..(240): a, c, t, g, unknown or other
  modified_base (290)..(290): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgtaccggnacgtatgtagcctggtaccagcagaaacctggccaggctccagacctccncatctcgtggggcacgtccagccgaccggggcccccgacactacccgagacaggttcaggtggcgacggtggggtcgtaggggacaggtagttcactctacaacaaactacagacaagacgtaggagtccgtaggaaagttagtttagacgtagttgttaatttctagtacaaactaattacgtacgtaccgtaccccttaggtacggtaccggttacggaccggtaaggggaccgtaagggtacggaaaacggttaaccgaaaacggtaccgtagtacgggacttacggaccaaccgtacgttaactcggttaccttactacgtttcccgttacccgtacctaccg

SEQ ID NO: 418041 - DNA, 573 bp, Homo sapiens
  misc_feature: GZ8MTXP02H2A78.2.25.C03.1.454.CMB.2.raw
  modified_base (200)..(200): a, c, t, g, unknown or other
  modified_base (208)..(208): a, c, t, g, unknown or other
  modified_base (238)..(238): a, c, t, g, unknown or other
  modified_base (323)..(323): a, c, t, g, unknown or other
  modified_base (393)..(393): a, c, t, g, unknown or other
  modified_base (433)..(433): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctccaggggaaangccacctntcctgcagggccagtcagagtgttaccggnacgtatgtagcctggtaccagcagaaacctggccaggctcccagactcctcactctcgtggggcatccagcgacgggcccccggnactcccagacaggttcaagtggcagtgggtctgggacagagttcacgtctacacaatcagcagactgganccgtgaagtattttgactagtttgtatttctgtactaaanaaatattacgtacgcccccgtttagtcgacggttcggccgaagggggacctaagggtggaaacgttacgaaaacgtaacgtgtacggacttcggactacccgaattcgtacgtcttacgacttcctttccccgactaacg

SEQ ID NO: 418042 - DNA, 634 bp, Homo sapiens
  misc_feature: GZ8MTXP02GHK9B.2.25.C03.1.454.CMB.2.raw
  modified_base (200)..(200): a, c, t, g, unknown or other
  modified_base (208)..(208): a, c, t, g, unknown or other
  modified_base (238)..(238): a, c, t, g, unknown or other
  modified_base (372)..(372): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctcaggggaaangccacctntcctgcagggccagtcagagtgttaccggnacgtatgtagcctggtaccagcagaaacctggccaggctcccagactcctcatctctgggcatccagcgacgggcccccggcactcccagacaggttcaggtggcaggtgggtctggggacagacgttcactcncacaatcagcagactaggacgcctagaagtagttttagctagttcgttatttctgttacaactaaatatacgtaccgtaccccgtttaggtacggtacggttccggaccggtaacgggggacccgtaaaggggtacgggtaaaacgttaacgaaaacggtaaacgttcgggttaacgggccgttacggaccaaacccggtacttaaccgttacggtttaccgtttacctaacgtttcccctttaccccggtacctttaaccg

SEQ ID NO: 418043 - DNA, 649 bp, Homo sapiens
  misc_feature: GZ8MTXP02HHAQL.2.25.C03.1.454.CMB.2.raw
  modified_base (200)..(200): a, c, t, g, unknown or other
  modified_base (239)..(239): a, c, t, g, unknown or other
  modified_base (363)..(363): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaanagccacctctcctgcagggccagtcagagtgttaccggnacgtatgtagcctggtaccagcagaaacctggccaggctccagactcctcatctctggggcatccagcacgggcccccgcactcccagacaggttcagtggcagtgggtctgggacagagttcncgtctcacaatcagcagacgtggacgcctaggaaacgtagtttttagccgtaggttggttaatttcgtagttactaaaactaaattacgttacgtaccgttacccccgtttacggttacgggtaccggttccgggacccggtaacgggggacccgtaaagggggtagggaaaacggtaccgaaaacggtaacgttcgggtacgggtacgttacgaccgtaacccgtaacgttccgttcggttaccgtttacctaactttccccgtttcccccggtacctttaaccg

SEQ ID NO: 418044 - DNA, 544 bp, Homo sapiens
  misc_feature: GZ8MTXP02HU766.2.25.C03.1.454.CMB.2.raw
  modified_base (202)..(202): a, c, t, g, unknown or other
  modified_base (240)..(240): a, c, t, g, unknown or other
  modified_base (320)..(320): a, c, t, g, unknown or other
  modified_base (517)..(517): a, c, t, g, unknown or other
tcagacgctcgacacacgaccggtgctcgatttagtagtgtagatttgggtttggggagagctgctcagttaggacccagagggaaccatggaaaccccagcgcagcttctctttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctctggggcatccagcacggcccccgnactcccagacaggttcagtggcagtgggtctgggacagagttcactctacacaatcagacagactggagcctagaagtattttgactagtgtatttctagttacaaactaatagttacgtacgtacccccgttagtcggacgttcggtccgagggggaccaggtaggaagtacgaaacgacgtagtggctgcaaccngtaactgtacttcactccttccgctac

SEQ ID NO: 418045 - DNA, 587 bp, Homo sapiens
  misc_feature: GZ8MTXP02IYXMF.2.25.C03.1.454.CMB.2.raw
  modified_base (197)..(197): a, c, t, g, unknown or other
  modified_base (231)..(231): a, c, t, g, unknown or other
  modified_base (283)..(283): a, c, t, g, unknown or other
  modified_base (312)..(312): a, c, t, g, unknown or other
  modified_base (367)..(367): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcacctgtctttgctcaggggaaangccacctctcctgcaggccagtcagagtgtacgnacgtatgtagcctggtaccagcaagaaacctggccaggctcccagactcctnatctcgtgggcatccagcacgggccccgnactcccagacaggttcagtgcagtggctgggacagagttcactctacaataaacncgagacagtacgtggacgacgtagaagttagttgacgtagttgttattcgtacgtactaaactaaattaacgttacgtaccgtacccgttaccgtacggtacggtacggtacggtaacgggaacggtaacggtacggtaacgtaacgtaaacgtaaacgtacgtacggtacgtacgacgacgtactaacgtacgttactactactccttaccgtactacg

SEQ ID NO: 418046 - DNA, 513 bp, Homo sapiens
  misc_feature: GZ8MTXP02IDTZA.2.25.C03.1.454.CMB.2.raw
  modified_base (200)..(200): a, c, t, g, unknown or other
  modified_base (427)..(427): a, c, t, g, unknown or other
tcagacgctcgacacacgaccggtgctcgatttagtagtgtagatttgggtttgggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggcacgtatgtagcctggtaccagcagaaacctggccaggctccagactcctcatctctgggcatccagcacgggccccgcatccccagacaggttcaatggcagtgggtctgggacagagttcactctcacaatcagcagactggagcctgaagtatttgcagtgtatttctgtacaaacaaatatcgtanccccttaagtggacgttcggctaggggaccaagggtgaagtcaaaacgactgtaggctgcacatctgtcttcatccttaccgcacg

SEQ ID NO: 418047 - DNA, 577 bp, Homo sapiens
  misc_feature: GZ8MTXP02GSPME.2.25.C03.1.454.CMB.2.raw
  modified_base (197)..(197): a, c, t, g, unknown or other
  modified_base (205)..(205): a, c, t, g, unknown or other
  modified_base (313)..(313): a, c, t, g, unknown or other
  modified_base (381)..(381): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctcagggaaangccacctntcctgcagggccagtcagagtgttaccggcacgtatgtagcctggtaccagcagaaacctggccaggctccagactcctcatctctgggcatccagcacggccccggnactcccagacaggttcagtcggcaggtggtctggacagagttcacgtctcacaatcagcagactgganctagaatagtttgactagttgtatttctagtacaaactaaattactacgtacgtaccccttaggtcgtacggttcggacgaacggggaccgtaaggtagggaaacgttacgaaaacggtaaccgtggtaacggcttacggacaacccgtaattcgtcggttaacttccgaagtttcccgttaacccgtccttaacg

SEQ ID NO: 418048 - DNA, 657 bp, Homo sapiens
  misc_feature: GZ8MTXP02H957V.2.25.C03.1.454.CMB.2.raw
  modified_base (201)..(201): a, c, t, g, unknown or other
  modified_base (240)..(240): a, c, t, g, unknown or other
  modified_base (410)..(410): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctcgaggggaaangccaccctctcctgcagggccagtcagagtgttaccggnacgtatgtagcctggtaccagcagaacctggccaggctcccagactcctcatctcgtggggcactccagcgacgggcccccgcactcccagacaggttcaagtggcaggtgggtctggggacaggagttcactctacactaatcacgcagacgtggagccgtagaaagtnttttagacgtagttagttatttcgtagtaactaaataattacttacgttaccgtacccccgttagtacggacctacgttccgggaccggtaacgggggaacccgtaaaaggggtaacggtaaacggtaaaccggtaaaaccggtaaacgttacgggtacggtaccgttacggaaccctaaacccgttaacgttcccgttacggtttacctttaccgtaacctttccccgttttacccccggtaaccc

SEQ ID NO: 418049 - DNA, 542 bp, Homo sapiens
  misc_feature: GZ8MTXP02GJX6L.2.25.C03.1.454.CMB.2.raw
  modified_base (201)..(201): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggcacgtatgtagcctggtaccagcagaaacctggccaggctcccagactcctcatctctggggcatccagcacggccccggcactcccagacaggttcaatggcagtgggtctgggacagagttcacgtctcacatcagcagactggagcctagaagtatttgctagtgtatttctgtacaaataatatcgtactccccttagtcggacgttcggccgtaaggggaccgaagggtacggaacgtacgaaaacgaacgtcggtaggactcgacacgtatcgtgtacttcactcttcccgactac

SEQ ID NO: 418050 - DNA, 629 bp, Homo sapiens
  misc_feature: GZ8MTXP02JVCTG.2.25.C03.1.454.CMB.2.raw
  modified_base (202)..(202): a, c, t, g, unknown or other
  modified_base (241)..(241): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccaccctctcctgcagggccagtcagagtgttaccggnacgtatgtagcctggtaccagcagaaacctggccaggctcccagacctcctcatctcgtggggcatccagcgacgggcccccggcactcccgagacaggttacaagtcggacacggtggggtcgtggggacaggtacgttcaccgtctacaacaatcagctaagacgtaggacgccgtaggaagtagttttagactaggttagttaatttcgtagtacaaactaaagttacgttacgtaccgtacccccgtttaggtcggtaaccggtttcgggacccgtaacgggggacccaaggggttacggaaacgttaaccgaaaacggtacgtaggtacggtacgtcgaccgtactacgtcgtacgttcttacgacttccttcccgacttacg

SEQ ID NO: 418051 - DNA, 656 bp, Homo sapiens
  misc_feature: GZ8MTXP02G4KFF.2.25.C03.1.454.CMB.2.raw
  modified_base (201)..(201): a, c, t, g, unknown or other
  modified_base (327)..(327): a, c, t, g, unknown or other
  modified_base (385)..(385): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcgagggccagtcagtagtgttaccggcacgtatgtagcctaggtacagcagaacctggccaggctccagactcctcatctcgtgggcatccgagccgaccggggcccccgnactcccgagaccgtggttacaggtggcagggttcgggtcgtaggggacagtacgttcncgtctacactaatcgaagcaagaccgtggacgtaccgtaggaagttagtttacggacgtagtttagttactttacgtacgtaacctaaactaaattacgtaccgttaccgttacccccgttaaggtacggtaccggttccggtaccggaacggggaaccggtaagggtacggaacgttaacgaaaaccggtagtacgggtacggacgtacggacctaacccgtagtaaccggttactaccgttactacctttcccgttccccgactttacg

SEQ ID NO: 418052 - DNA, 578 bp, Homo sapiens
  misc_feature: GZ8MTXP02F3AB7.2.25.C03.1.454.CMB.2.raw
  modified_base (201)..(201): a, c, t, g, unknown or other
  modified_base (240)..(240): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggcaggctccagactcctcatctctggggcatccagcacggccccgcactcccagacaggttcaagtggcaggtcgggtcgtggggacaggtacgttcacgtctacgacaatcacgcagacgtggacgccgtagaagtactttgactaggttgttatttctagttacaaacgtatactcgtaccgtccccttagtcggtacgttcggacgtacggggaccgaagggtaggtaacgtacgaaaacgtacgtaggtcgggtctcgacctacgacttaacgtcgttacttcgtacttccgttcccgctacg

SEQ ID NO: 418053 - DNA, 655 bp, Homo sapiens
  misc_feature: GZ8MTXP02HAQG7.2.25.C03.1.454.CMB.2.raw
  modified_base (202)..(202): a, c, t, g, unknown or other
  modified_base (241)..(241): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaanagccacctctcctgcagggccagtcagagtgttaccggnacgtatgtagcctggtaccagcagaaacctggccaggctcccagacctcctcactctcgtggggcatccagccgacgggcccccggcactcccagacaggttcaggtcggcaggtgggtcgtggggacaggagttcaccgtctcgacaatcagcagacgtggagaccgtagaagtatttgacgtagttagttactttcgtagtactaaactaagtacgttaccgtaccgttacccccgttaacggtcggtaccggtttcgggaccgtaacgggggtaacccgtaaggggtacggaaacgttaacggaaaaccggtaacggttacggtacggtaccgttacggacctaacccgtaagttccgttacggtttacccgtttactaaccgtttcccgtttaaccccggctttaaccgg

SEQ ID NO: 418054 - DNA, 589 bp, Homo sapiens
  misc_feature: GZ8MTXP02GCZFB.2.25.C03.1.454.CMB.2.raw
  modified_base (201)..(201): a, c, t, g, unknown or other
  modified_base (209)..(209): a, c, t, g, unknown or other
  modified_base (239)..(239): a, c, t, g, unknown or other
  modified_base (367)..(367): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctntcctgcagggccagtcagagtgttaccggnacgtatgtagcctggtaccagcagaaacctggccaggctcccagactcctcatctcgtgggcatccagcgacggcccccgcactcccagacaggttcaagtggcaggtggtcgtgggacaggagttcnctctcacaatcagcagacgtggacgcctagaagtatttgctagtgtattctgtacaaactaatacgttcgtaccgtaccccgttacgtcggtacggttcggaccgaacggggtaccgtaagggtaggaacgtaacgaaaacgtacgtacggtacggtacgtcgacctaaccgacttaaccgttcgttaccttacgtaccttcccgttaccccgtcttaaccg

SEQ ID NO: 418055 - DNA, 598 bp, Homo sapiens
  misc_feature: GZ8MTXP02GKA66.2.25.C03.1.454.CMB.2.raw
  modified_base (200)..(200): a, c, t, g, unknown or other
  modified_base (238)..(238): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccacctctcctgcagggccagtcagagtgttaccggnacgtatgtagcctggtaccagcaagaaacctggccaggctccagactctcatctcgtgggcatccagcgaccgggccccgcactcccgagccgaggttcagtggcaggtgggctgggacaggtagttcacgtctcaactaatcgaagcagacgtggacgctaggaatagtttgacgtagtcgttatttcctagtacctaaataattacgttaccgtacgtacccccgtttaggtaccgggtacggtttaccggaccggacggggtaaccgaagggtacggaacggtacgaaaacggaacgttggtacggactacggactacctacgtcgttcgttacttcgtacttcctccgaccttacg

SEQ ID NO: 418056 - DNA, 597 bp, Homo sapiens
  misc_feature: GZ8MTXP02GD3GE.2.25.C03.1.454.CMB.2.raw
  modified_base (198)..(198): a, c, t, g, unknown or other
  modified_base (236)..(236): a, c, t, g, unknown or other
  modified_base (319)..(319): a, c, t, g, unknown or other
  modified_base (399)..(399): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctcaggggaangccacctctcctgcagggccagtcagagtgttaccggnacgtatgtagcctggtaccagcagaaacctggccaggctcccagactcctcatctctggggcatccagccacgggcccccggnactcccagacaggttcagtggcagtgggctggggacagagttcactctacaacaatccagcagactggagcctagaagtntttgctagtgttattctagttacaaactaatatcgtacgtaccccctttaggtcggaccgtttcggaccgtaagggggaccctaaaggggttcggaaaacgttacgaaaaacggtacgtagggtacgggacttcggaacctaccctaagtcttcggttacctttaccgtaacgttccctttccccgacccgtttaacg

SEQ ID NO: 418057 - DNA, 604 bp, Homo sapiens
  misc_feature: GZ8MTXP02JGLF7.2.25.C03.1.454.CMB.2.raw
  modified_base (201)..(201): a, c, t, g, unknown or other
  modified_base (239)..(239): a, c, t, g, unknown or other
  modified_base (320)..(320): a, c, t, g, unknown or other
  modified_base (359)..(359): a, c, t, g, unknown or other
  modified_base (433)..(433): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggnacgtatgtagcctggtaccagcagaaacctggccaggctcccagactcctcatctcgtgggcatccagcacgggcccccgnactcccagaccaggttcaggtggcaggtggtctgggacnggagttcacgtctcaacgaatcgaagcagacctggacgccgtagaagtagttttgactagttgttatttacgtntacgaactatacttcgtactacccccgttagtcggtaccgttccgggacgaacggggaccgtaaaggggtacggaaacgtaccgaaaacggtagttacggtaggccgtacggaccaaccgtagttccgttacggtacctttcctaacgttccctttacccgctttaaaccg

SEQ ID NO: 418058 - DNA, 633 bp, Homo sapiens
  misc_feature: GZ8MTXP02JOXT5.2.25.C03.1.454.CMB.2.raw
  modified_base (201)..(201): a, c, t, g, unknown or other
  modified_base (241)..(241): a, c, t, g, unknown or other
  modified_base (360)..(360): a, c, t, g, unknown or other
  modified_base (368)..(368): a, c, t, g, unknown or other
tcagacgctcgacacacgaccggtgctcgatttagtagtgtagatttgggtttggggagagctgctcagttaggacccagagggaaccatggaaaccccggcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctcccagactcctcatctctgggcatccagcagggcccccggcactccccagacaggttcagtggcagtgggtctggacagngttcactntcacaatcagcagactggagcctagaagtattttgactagtgttaactttctacgtactaaaaccaattaagttaccgtaacgtaccccctttaacgggagggttaccgtttaccgggaccgtaagggggaacccaaaggggttacgggaaaacgttaacggaaaaccggtaaaaccgtaggttacggggacttagggaccctaaaccgtacttaccgttcgtacctttaccaaacttcccttccccggtacctactttacccgg

SEQ ID NO: 418059 - DNA, 596 bp, Homo sapiens
  misc_feature: GZ8MTXP02GBG1F.2.25.C03.1.454.CMB.2.raw
  modified_base (200)..(200): a, c, t, g, unknown or other
  modified_base (238)..(238): a, c, t, g, unknown or other
  modified_base (248)..(248): a, c, t, g, unknown or other
  modified_base (366)..(366): a, c, t, g, unknown or other
  modified_base (403)..(403): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccacctctcctgcagggccagtcagagtgttaccggnacgtatgtancctggtaccagcagaaacctggccaggctccagacctcctcatctcgtggggcatccgagcgacgggcccccgcactcccagcaggtcaggtggcaggtggtcgtgggacagagttcnctcacacaatcaaggcagacgtggacgcgtagaagtntttagcttagttagttatttacgtgttaacaaactattaacgtcgttaccgtacccccgttaggtcggtaccggttaccggaccggtaacggggacccaaggggtacgggtaaacgtaaccgaaaacggtaagtcggtacggtcgtacgaccacctagtcttacgtcttactacctccgtttaccccgactac

SEQ ID NO: 418060 - DNA, 696 bp, Homo sapiens
  misc_feature: GZ8MTXP02H54X6.2.25.C03.1.454.CMB.2.raw
  modified_base (201)..(201): a, c, t, g, unknown or other
  modified_base (240)..(240): a, c, t, g, unknown or other
  modified_base (323)..(323): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggccaggctccagactcctcatctcgtgggctatccagccgacggcccccggnactcccagacaggttcagtggcaggtgggtcgtgggacaggtcgttcacttcgtacactaatcgaggcaagaccgttagggacgtccgtagtaaagtactttttaggactaaggtttaggttaactttttcgtaacggttaccaaacttaaacttacgtttaccgtaacccggttacccccgtttaaaccgggttcgggtaaacccgggtttccggggaacccggtacgggggtaaaccccgtaaagggggttacggggaaaaccgttaaacggaaaacccggttacggtacggtacgggtacctacggacctaccgtaacgttccgttcgttaccgtttacaacccttttcccgtaccccgtacctttaccg

SEQ ID NO: 418061 - DNA, 635 bp, Homo sapiens
  misc_feature: GZ8MTXP02H5L6U.2.25.C03.1.454.CMB.2.raw
  modified_base (202)..(202): a, c, t, g, unknown or other
  modified_base (242)..(242): a, c, t, g, unknown or other
  modified_base (328)..(328): a, c, t, g, unknown or other
  modified_base (360)..(360): a, c, t, g, unknown or other
  modified_base (374)..(374): a, c, t, g, unknown or other
  modified_base (412)..(412): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggcctcccagataccacggagagattgtgttgacgcagtctccaggcaccctgtctttgtctccgaggggaaangccaccctctcctgcagggccagtcagagtcgttaccggnacgtatgtagcctggaccagcaagaaacctggcaggctcccagacctcctcactctccgtgggcatccgagccgacgggcccccgnactcccagacaggtacaggtgctggtggtcgngggacagtagttcnctctacacaatcagcagaccgtggacgactagtaagtnttttagacttagttgttatttcgtagtactaaactaagttaacgttccgtaccgtacccccgttaagggtacggtaaccggttcgggaaccggacggggtaacccgtaagggtacgaaaacggtacgaaaacggtaacgtcggtacggacgtacgtaccgtaaccgtaagttccggttaacgttcctttaccgtaactttcccccgttacccggtcttaaccg

SEQ ID NO: 418062 - DNA, 649 bp, Homo sapiens
  misc_feature: GZ8MTXP02HFVIL.2.25.C03.1.454.CMB.2.raw
  modified_base (201)..(201): a, c, t, g, unknown or other
  modified_base (209)..(209): a, c, t, g, unknown or other
  modified_base (239)..(239): a, c, t, g, unknown or other
  modified_base (368)..(368): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctntcctgcagggccagtcagagtgttaccggnacgtatgtagcctggaccagcagaacctgcaggctccagactctcatctcgtgggcatccagccgaacgggcccccggacacgtcccagacgaggttcaggtggcagtgggtctgggacagtacgttcnctctacaactagtacagcaagactagggagacctagaaagtagttttcgacttagttagttaatttcgtgtactaaactaattaacgttaccgtaccgttacccccgtttaacgtcgggttaccgttaccgggaccggaaacgggggtaaccgtaaacggggttacgggaaaacggttaaccgaaaaccgggtaacgttacggtacgggttacacggtacccaacgtaacgttccgtacgtttaccgttacctaacctttcccgttaccccgtaccttaac

SEQ ID NO: 418063 - DNA, 556 bp, Homo sapiens
  misc_feature: GZ8MTXP02IXW1C.2.25.C03.1.454.CMB.2.raw
  modified_base (367)..(367): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaagagccaccctctcctgcagggccagtcagagtgttaccggcacgtatgtagcctggtaccagcagaaacctggccaggctcccagactcctcatctctggggcatccagcacgggcccccggcactcccagacaggttcagtggcagtgggtctgggacagagttcnctctcacatcagcagactggagcctagaagtattttgctagttgttatttctgtacaaacgaatatcgtacgtcccctttaacgtcggtacgttcgggccgaacgggggaccaagggtcggaagtacgaaaacgaacgtggtacggctcgacacccgataacgtgttcttactattcctttctcgtacc

SEQ ID NO: 418064 - DNA, 600 bp, Homo sapiens
  misc_feature: GZ8MTXP02JOHDH.2.25.C03.1.454.CMB.2.raw
  modified_base (201)..(201): a, c, t, g, unknown or other
  modified_base (323)..(323): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgttaccggctacgtatgtagcctggtaccagcagaaacctggccaggctccagactcctcatctcgtgggcatccgagcgaccgggcccccgnactccccgagaccgaggttaccaagtcggctaggtcgggtctgggaactagacgttcacgtctcaacgtatcagtcagactggacgctaggaagtatttgctaggttgttaattcgtagttacaaataatacgtaccgtacgtacccccgttaggccggttacggttccggaccggtaaggggaccctaaagggtaggaacgttacgaaaacgtacgtggtacgggactcgacgtacctagtccgtgttaccttcgtactccgtttccgacttaccg

SEQ ID NO: 418065 - DNA, 586 bp, Homo sapiens
  misc_feature: GZ8MTXP02GDE9Y.2.25.C03.1.454.CMB.2.raw
  modified_base (198)..(198): a, c, t, g, unknown or other
  modified_base (235)..(235): a, c, t, g, unknown or other
  modified_base (274)..(274): a, c, t, g, unknown or other
  modified_base (408)..(408): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcaccctgtctttgctcgagggaaangccacctctcctgcagggccagtcagagtgtaccggnacgtatgtagctggacagcagaactgcaggctccagacnctcatctcgtgggcatccagcgacggccccgcactcccagacacggttcaggtggcaggtgggtcgtgggacagtacgttcacgtctacaacatcgaagcaagactggacgtcctagataatttggactaggtntattcgtgttaacaaactaattacgtcgtaccgtaccccgttaggtaccggtacggttcggaccggtaggggaaccgaacggggtagaacgtaacgaaaacggtacgtacggttacggacgttacggaccaaccgtaacgttcgttcgtactttcaccttccgtacccgtacttaacg

SEQ ID NO: 418066 - DNA, 562 bp, Homo sapiens
  misc_feature: GZ8MTXP02F0P8L.2.25.C03.1.454.CMB.2.raw
  modified_base (200)..(200): a, c, t, g, unknown or other
  modified_base (238)..(238): a, c, t, g, unknown or other
  modified_base (364)..(364): a, c, t, g, unknown or other
  modified_base (387)..(387): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccaggggaaangccacctctcctgcagggccagtcagagtgttaccggnacgtatgtagcctggtaccagcagaacctggccaggctcccagactcctcatctctgggcatccagcacggcccccggcactcccagacaggttcagtggcagtggggtctggggacagacgttcnctctcacaatcagcagactgganctagaagtatttgctagtgtatttctgtactaaactaatatacgtacgtcccccgttaggtacggtacggttccggaccgtacgggggaccaaggggtacggaacggtacgaaaacggaacgtcggtacggactcggaccaccacgtcgtacgtcttacacttcctacccgctac

SEQ ID NO: 418067 - DNA, 563 bp, Homo sapiens
  misc_feature: GZ8MTXP02GVJ53.2.25.C03.1.454.CMB.2.raw
  modified_base (199)..(199): a, c, t, g, unknown or other
  modified_base (238)..(238): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctcaggggaaangccacctctcctgcagggccagtcaggagtgttaccggntacgtatgtagcctggtaccagcagaaacctggccaggctccagactcctcatctcgtgggcatccagcgacgggccccgcactccccgagacgaggttcagtggcacggtgggtctggggacaggagttcactcgacacaactcagcagacgtggacgcctagaagtatttgactagtgttattctagtactaaactatatacgtactcccgttagacggtacgttcggccgaaggggaccaagggtacgaaagtacaaaacggtacgtgtacgggactcggaccactacgtcgtacgttctactacgttcctcccgtactacg

SEQ ID NO: 418068 - DNA, 553 bp, Homo sapiens
  misc_feature: GZ8MTXP02F442H.2.25.C03.1.454.CMB.2.raw
  modified_base (201)..(201): a, c, t, g, unknown or other
  modified_base (240)..(240): a, c, t, g, unknown or other
  modified_base (319)..(319): a, c, t, g, unknown or other
  modified_base (366)..(366): a, c, t, g, unknown or other
  modified_base (370)..(370): a, c, t, g, unknown or other
  modified_base (373)..(373): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccaccctctcctgcagggccagtcagagtgttaccggnacgtatgtagcctggtaccagcagaaacctggccaggctcccagactcctcatctcgtgggcatccagcacggccccgnactcccagacaggttcaggtggcagtggggtctggggacagagttcnctcncanaatcagcagactggagctagaagtatttgactagtgttattctgtactaaataatacgtacgtacgtacccccgttagtacggtacgttcggacgacggggtaaccgaaggtacggaaagtacgaaaacgtaactaggtacgacgtagacactatctacgtctactatcctccgacctac

SEQ ID NO: 418069 - DNA, 617 bp, Homo sapiens
  misc_feature: GZ8MTXP02GS9F9.2.25.C03.1.454.CMB.2.raw
  modified_base (198)..(198): a, c, t, g, unknown or other
  modified_base (206)..(206): a, c, t, g, unknown or other
  modified_base (225)..(225): a, c, t, g, unknown or other
  modified_base (319)..(319): a, c, t, g, unknown or other
  modified_base (332)..(332): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctcaggggaaangccacctntcctgcagggccagtcagngtgttaccggcacgtatgtagcctggtaccagcagaaacctggccaggctccagacctcctcatctcgtgggcatccagccgacgggcccccgnactcccgagacgnggttcagtggcaggtgggtctggggacaggtacgttcacgtctacgacaactcgaacgcagactggacgctagaagtgtttagctagttcgttattacgtagtacaaactaattacgttacgtaccgttaccccgttacggtacggtaccggttcgggaaccggtacggggtaaccgtaagggtacggaaaacggtaacgtaaaacggtaacggtcggtacggtacgtacggacctaccgtataaccgttacgttaccgttctacgttccttacccgactttacg

SEQ ID NO: 418070 - DNA, 587 bp, Homo sapiens
  misc_feature: GZ8MTXP02HT29Q.2.25.C03.1.454.CMB.2.raw
  modified_base (197)..(197): a, c, t, g, unknown or other
  modified_base (205)..(205): a, c, t, g, unknown or other
  modified_base (235)..(235): a, c, t, g, unknown or other
  modified_base (320)..(320): a, c, t, g, unknown or other
  modified_base (553)..(553): a, c, t, g, unknown or other
  modified_base (586)..(586): a, c, t, g, unknown or other
tcagacgctcgacacacgaccggtgctcgatttagtagtgtagatttgggtttggggagagctgctcagttaggacccagaggaaccatggaaaccccagcgcagcttctcttcctcctgctactctggctccagataccacggagagattgtgttgacgcagtctccaggcacctgtctttgtctccaggggaaangccacctntcctgcagggccagtcagagtgttaccggnacgtatgagcctggtaccagcagaaaccctggccaggctcccagacctcctcatctctggggcaatccagccaagggcccccggnactcccagacaggttcaaagtggacagtgggtctgggacagagttcactcacacaatcagcagacctggacgaccgtaggaagtaacttttggaccgaagttggtaacttactttcgtacgttaaacctaaactaaaattagttaccgtaccgtacccccgttagacgggtaccgttccggacggaacgggaaccgttaagggacggaactacgaaaacgacgtggacgtcgngacacgtaatcgtcttctacactccgttacccnc

SEQ ID NO: 418071 - DNA, 571 bp, Homo sapiens
  misc_feature: GZ8MTXP02IQKV5.2.25.C03.1.454.CMB.2.raw
  modified_base (199)..(199): a, c, t, g, unknown or other
  modified_base (208)..(208): a, c, t, g, unknown or other
  modified_base (238)..(238): a, c, t, g, unknown or other
  modified_base (288)..(288): a, c, t, g, unknown or other
  modified_base (316)..(316): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccaccggagagattgtgttgacgcagtctccaggcaccctgtctttgtctcaggggaaangccaccctntcctgcagggccagtcagagtgttaccggnacgtatgtagcctggtaccagcagaaacctggccaggctccagactcctnatctctgggcatccagcacgggccccgnactcccagacaggtcagtggcagtggtctggggacaggagttcactctacaactaaatcagcaagacgtggacgcctagaagtaattttgactagttgtaatttctgtacaaacaagtacttcgtacgtcccccttagtacggtacgttcggaccgtaacggggaccgtaaagggtcggaaagttaccgaaaacggtaacgtggtaaggcttacggaccaacattctcgtactttcaacttcctacccgtactac

SEQ ID NO: 418072 - DNA, 563 bp, Homo sapiens
  misc_feature: GZ8MTXP02GN4EK.2.25.C03.1.454.CMB.2.raw
  modified_base (199)..(199): a, c, t, g, unknown or other
  modified_base (207)..(207): a, c, t, g, unknown or other
  modified_base (236)..(236): a, c, t, g, unknown or other
  modified_base (316)..(316): a, c, t, g, unknown or other
  modified_base (385)..(385): a, c, t, g, unknown or other
  modified_base (414)..(414): a, c, t, g, unknown or other
  modified_base (418)..(418): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctcgaggggaaangccacctntctgcagggccagtcagagtgttaccggnacgtatgtagcctggaccagcagaaacctggccaggctcccagactctcatctctggggcatccagcgacggcccccggnactcccagacaggttcagtggcagtgggtctggggacagagttcatctacacaatcagcagactggaanctagaagtattttgctaagtgttatttcnttanaaacaaatatacgtacgtccccctttaagtcggtaccgtttcggacggtaacgggggaaccaaaggggtaggaaagttacgaaaacgtaaacgtaggtacgggcttcggacaccaatctggtcttcaattcctttacccgcctac

SEQ ID NO: 418073 - DNA, 686 bp, Homo sapiens
  misc_feature: GZ8MTXP02HRGLE.2.25.C03.1.454.CMB.2.raw
  modified_base (199)..(199): a, c, t, g, unknown or other
  modified_base (319)..(319): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccacggagagattgtgttgacgcagtctccaggcacctgtctttgtctcgaggggaaangccacctctcctgcagggccagtcagagtgttaccggcacgtatgtagcctggaccagcagaaacctggccaggcctcccagactcctcatctcgtgggcacgtccagcgacggccccgnactcccagacaggttcaggtcggcaggtcgggtcgtcggggacaggtacggttcacgttctcaacgtaatcgagacagacgttaggacgtccgtaagaagttatttttacggactaggttagttacgttttcgtacgttaacgtaaacaaattacggttaccgttaacccggtacccccgtttaagggtcggggttaacccggtttaccggggacccgggtaacgggggtaaacttaacgggggtaacgggtaaacggttaaccggaaaaacggtaaacgtcggtacgggtacgttacgggacctaccgtaacgttccgtttacgtacccgtttactaccggtttaccctccccggttaccgtaccg

SEQ ID NO: 418074 - DNA, 736 bp, Homo sapiens
  misc_feature: GZ8MTXP02FLIRH.2.25.C03.1.454.CMB.2.raw
  modified_base (203)..(203): a, c, t, g, unknown or other
  modified_base (215)..(215): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaaggggaaangcccacctctcngcacgggccagtcagagtcgtaccggcacgtatcgtagctaggtaccagacaacgaacgtggaccaggcctaccacgacctcctacactcgtcgtcggggcacgtccacggcgacccgggccccgcacctacccgagacgtacggtcgaggcgacgtacggtcgggtcgtagggactaggtacgttcacctcctaccaaactaacgtcacgacgacgtacgtaggacgtacgtaggtaaagttagtttcgacgttagttagtttacgttaccttagtaaacctaaacttaaacgttacgttaccgttaacccgttaccccggttaacggtacccggggttaaccgggttacccggggaaccggttaaaccgggggaaccgtaaacgggggtaacgggtaaaacggtaaaccggtaaaacggttaacggttacgggacggtaccggtacgtaacccgtaccgttaacgtaacgtttccggttacctttacgttacccgtttccctttacccgctttaaccgg

SEQ ID NO: 418075 - DNA, 710 bp, Homo sapiens
  misc_feature: GZ8MTXP02G1JMT.2.25.C03.1.454.CMB.2.raw
  modified_base (199)..(199): a, c, t, g, unknown or other
  modified_base (238)..(238): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctcgagggaaancgccacctctcctgcagggccagtcagagtgttaccggntacgtatgtacgctggtaccagacgaacgaaccgtggccaggcctccgagacctcctcactctcgtcgggctacgtccgaggccgaccgggcccccgactaccgtcccgaacgacgtacggtacgaggtcggcgtagggtcgggtcgtaggggactaggtacgttcacgtctacaactaacgtcgaacgacgaacgtaccggttaggacgtaccgtagggtaaagttacgttttacgacgttaggtttacgttaacgtttacttaggtaaacctaaactaaacgttacgttaccgtaacccgtcccgtttacggtaccggtacggttcggaccggtacggggaaccgtaggggtaacggtaaacgtaaccgtaaaacggtacgttacgggtacggtacctacgggaccctaaccggtattaacccggttacgttacgtttaccaacggtttcccctttacccgactttaacg

SEQ ID NO: 418076 - DNA, 679 bp, Homo sapiens
  misc_feature: GZ8MTXP02FR0TV.2.25.C03.1.454.CMB.2.raw
  modified_base (198)..(198): a, c, t, g, unknown or other
  modified_base (208)..(208): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgctcgagggaaangcccacctcncctgcagggccagtcagagttcgtaccggctacgtatgtacgcctggtaccagacaacgaaaccgtcggaccgaggcctaccgacgtacctcctacacttcgtcggtcggggcacgtaccgacggaccggacccggggcccccggacgacctaccccgaaggtaaccggtacgggttccgaggtcggacgtacgggtcggggtaccgtaggggactagtacgttcacgtctacgacaatcgagcagtacgtggacgtacgtagtaagttagtttgacgttaagttcgtttattacgtacgtaaacaaacgtaattacgtaccgttaccgtacccgttagtaccggtacggttccggacggtacgggtaaccgtaagggtacggtaaacgtaacgaaaacggtacgtcggtagtacgtacgaacctacgtacgtcgttacttccgttactccgtttacccgtcctacgtacg

SEQ ID NO: 418077 - DNA, 576 bp, Homo sapiens
  misc_feature: GZ8MTXP02JLYMX.2.25.C03.1.454.CMB.2.raw
  modified_base (201)..(201): a, c, t, g, unknown or other
  modified_base (241)..(241): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaanagccaccctctcctgcagggccagtcagagtgttaccggnacgtatgtagcctggtaccagcagaaacctggccaggctccagactcctcatctctggggcatccagcaggcccccggcactcccagacaggttcagtggcagtggtctgggacagagttcactctcacatcagcagactggagcctgaacgtattttagctagtgtatttctagtacaactaaatatcgtaagtcccccgttaggtcggtacgtttcgggaccgacgggggacccaaggggtcgaaaggttacgaaaacggacgtacggtacggtctacggaccacctaatccgtaggttaccttactaacgtacctttccccggaccttaacg

SEQ ID NO: 418078 - DNA, 609 bp, Homo sapiens
  misc_feature: GZ8MTXP02IMYPR.2.25.C03.1.454.CMB.2.raw
  modified_base (199)..(199): a, c, t, g, unknown or other
  modified_base (258)..(258): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctcgaggggaangcccacctctcctgcagggccagtcagagtgttaccggcacgtatgtagcctggtaccngcagaacctggccaggctccagacctcctcatctcgtgggcatccagccgacgggccccggcactcccagacacggttacaagtggcaggtcgggtcgtagggacaggtacgttccacgtctacaacaactcagcgagtacgtaggacgtcgtaagtaagttagttttacgactagttaggttactttcgtagtaactaaacctaaattacgttacgtacccgtccccgtttaacgtcggtacggttcggaccgaacggggaccgtaaagggtcgggtaaacgtacgaaaacgtacgtaggtacggacgtcgaccacctagtcttcgttctactactcctacccgactacg

SEQ ID NO: 418079 - DNA, 588 bp, Homo sapiens
  misc_feature: GZ8MTXP02I8AOU.2.25.C03.1.454.CMB.2.raw
  modified_base (199)..(199): a, c, t, g, unknown or other
  modified_base (227)..(227): a, c, t, g, unknown or other
  modified_base (238)..(238): a, c, t, g, unknown or other
  modified_base (320)..(320): a, c, t, g, unknown or other
  modified_base (365)..(365): a, c, t, g, unknown or other
  modified_base (391)..(391): a, c, t, g, unknown or other
  modified_base (436)..(436): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccgagggaanagccacctctcctgcagggccagtcagngtgttaccggnacgtatgtagcctggtaccagcagaaacctggccaggctcccagactcctcatctcgtgggcatccagcgaccgggccccgnactcccagacaggttcaggtgcaggtggtctgggactgacgttcnctctcaacgtatcaagccgagtaccnggacgccctaggaaagttagtttgacgtagttagtttactttacngtttaacaaactaaagttacgtccgttacgtcccccgtttaagtcggtaccgttcggaccggacgggacgtaacggggtagaacggtacgaaaacggtactaggcggtactacgaccactattcgattactctacgtcccttccggactacg

SEQ ID NO: 418080 - DNA, 591 bp, Homo sapiens
  misc_feature: GZ8MTXP02HRB6I.2.25.C03.1.454.CMB.2.raw
  modified_base (200)..(200): a, c, t, g, unknown or other
  modified_base (238)..(238): a, c, t, g, unknown or other
  modified_base (286)..(286): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcacctgtctttgtctccaggggaaangccacctctcctgcagggccagtcagagtgttaccggnacgtatgtagcctggaccagcagaaacctggccaggctccagactccncatctcgtggggcatccagcgacgggccccgcactcccagacaggtcagtggcaggtgggtctgggactaggacgttcactctcacaactcagcagactggagcctagaagtattttcgctagtgttatttctgttacaaactaattacttacgtacgtacccccgtttagtacggtccgtttacggaccggtacgggggaacccgaagggttacggggaaaacgttaaccgaaaacggtaaccgttggacggtacgtcgaccgtacctagtccgtgtacctttcgactttccttcccgcttacg

SEQ ID NO: 418081 - DNA, 696 bp, Homo sapiens
  misc_feature: GZ8MTXP02FF2WO.2.25.C03.1.454.CMB.2.raw
  modified_base (240)..(240): a, c, t, g, unknown or other
  modified_base (260)..(260): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaagagccaccctctcctgcagggccagtcagagtgtaccggnacgtatgtagcctggtaccngcagaaacctggccaggctcccagactcctcatctctggggcatcccagccagggccccccggcactccccagacaggttcaagtggcaggtggggtctggggacagacgttcgtacctcctacaactaaacgtcaagaccaagaacgttcgggaacgcccgtaggtaaagtaagtttttcgacgtaaggttacggtttattttacgtacgttaacctaaacctaaatttaacgttaccggtaccgttaccccccgtttacggttaccgggtaccgggtttaccgggaccgtacgggggaaacccgaaggggttacgggaaaacgtacgaaaaccggtaacgtacgggtacggccgttacggaccctaaccgtaacttcccgttacggttaccgtttaccgtacgtttacccttacccccggtaccctttaaaccg

SEQ ID NO: 418082 - DNA, 654 bp, Homo sapiens
  misc_feature: GZ8MTXP02H546V.2.25.C03.1.454.CMB.2.raw
  modified_base (203)..(203): a, c, t, g, unknown or other
  modified_base (241)..(241): a, c, t, g, unknown or other
  modified_base (291)..(291): a, c, t, g, unknown or other
  modified_base (371)..(371): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaaggggaaangccaccctctcctgcagggccagtcagagtgtaccggnacgtatgtagcctggtaccagcagaaacctggccaggctcccagactccncatctcgtggggcatccagcgacgggcccccgcactcccagacaggttcaggtggcaggtgggtctgggacagtagttcnctctacacaatcagcaagaccgtggacgtaccgtaggtaaagtagtttttgacgttaggttacggtttattttcgtaggttacctaaaacgtaaacttaacgttaccggtaaccgtacccccgtttaacgggttacgggtaaaccggtttccgggaccggtaacgggggtaaccctaaagggggtacggaaaacgttacgaaaaaccggtacgtacggttacggacgtacggaccaccgtaacttcgtacgttacttacacgtttccctacccgtacctaacg

SEQ ID NO: 418083 - DNA, 558 bp, Homo sapiens
  misc_feature: GZ8MTXP02HHY6A.2.25.C03.1.454.CMB.2.raw
  modified_base (199)..(199): a, c, t, g, unknown or other
  modified_base (208)..(208): a, c, t, g, unknown or other
  modified_base (238)..(238): a, c, t, g, unknown or other
  modified_base (287)..(287): a, c, t, g, unknown or other
  modified_base (316)..(316): a, c, t, g, unknown or other
  modified_base (377)..(377): a, c, t, g, unknown or other
  modified_base (405)..(405): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctccagataccacggagagattgtgttgacgcagtctccaggcacctgtctttgctccgaaggggaaanagccacctntcctgcagggccagtcagagtgttaccggnacgtatgagcctggtaccagcagaaacctggccaggctcccagactccnatctcgtgggcatccagccacggccccgnactcccagacaggttcaggtggcaggtggtcgtggggacaggattcgactctacaacaaanacagacagacgtggacacgtagaagttntttgactagttattattactataacaaataatacttacgtaccgtacccgttagtacggtacgtcggacggacgggaacgtaaggtaggaaacgtacgaaacgtacgtaggtagacgtacgactacactcgtctactctactccgtaccactc

SEQ ID NO: 418084 - DNA, 702 bp, Homo sapiens
  misc_feature: GZ8MTXP02GIRJR.2.25.C03.1.454.CMB.2.raw
  modified_base (200)..(200): a, c, t, g, unknown or other
  modified_base (239)..(239): a, c, t, g, unknown or other
  modified_base (249)..(249): a, c, t, g, unknown or other
  modified_base (288)..(288): a, c, t, g, unknown or other
tcagacgctcgacacacgaccggtgctcgatttagtagtgtagatttgggtttggggagagctgctcagttaggacccagaaggaaccatggaaaccccagcgcagcttctcttcctcctgctactctggctcccagataccaccggagagattgtgttgacgcagtctccaggcaccctgtctttgctccaggggaaangccaccctctcctgcagggccagtcagagtgttaccggnacgtatgtancctggtaccagcagaaacctggccaggctccagactccncatctcgtggggcatccgagcgacgggcccccggcactccccgagaccgtacggtttacaagtcggacgacggtcggggtcgtaggggactaggagttcacgtctacgaacaatcacgcaagtacgtgggacgtccgtagtaaagtagttttacgacgttagtagtttatttcgtagtaacctaaactaaatttaactacggttaaccgtacccccgtttacggttaccgggtaccggtttaccgggacccggtaacgggggtaaccgtaaacggggtacgggtaaaacgtaaccgtaaaaacgggtaaaccgtttagggtaacggtaccgtagggtaccctaaccggttaaacttccgttacggtttaccgtttactaaccggtttccctttaccccggtacctttaaaccgg

SEQ ID NO: 418085 - DNA, 707 bp, Homo sapiens
  misc_feature: GZ8MTXP02GDS1A.2.25.C03.1.454.CMB.2.raw
  modified_base (201)..(201): a, c, t, g, unknown or other
  modified_base (399)..(399): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgctccgaggggaaanacgccaccctctcctgcagggccagtcagagtgttaccggcacgtatgtacgcctggtaccagcaagaaacctggccacggcctcccacgacctcctcactctcgtggggcactccgagccgaccgggcccccgcactcccgaagaccgtaggttcgaggtggcgacggtcggggtcgtaggggaacaggtacgttcnccgtcctacaactaagtcaagcaacgtacgaggacgccgtaggaaagtgtttacgcgttagttacgttatttacgtacgtactaaactaaagttacgttaccgtacccgttaccccggttacggttaccgggttaccggttaccgggaccgggtaaacggggtaaccggtaaacggggtaacgggaaacgttaaaccgaaaacggtaacggtacgggttacgggaccgttacggaccctaaccgttacttaaccgtttaccggttacccgtttacgtacctttaccccgtttccccggtactttaccg

SEQ ID NO: 418086 - DNA, 601 bp, Homo sapiens
  misc_feature: GZ8MTXP02FK5MO.2.25.C03.1.454.CMB.2.raw
  modified_base (248)..(248): a, c, t, g, unknown or other
  modified_base (369)..(369): a, c, t, g, unknown or other
  modified_base (401)..(401): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaagagcccaccctctcctgcagggccagtcagagtgttaccggcacgtntgtagcctggtaccagcagaaactggccaggctcccagactcctcatctctgggcatccagcgacggccccggcactcccagacaggttcagtcggcaggtggtcgtgggacagacgttcnctctcaacgaatcaacgacagacgtgggaacnccgtaggaaagttattttgactagttgttatttctacgtacaaactaattaactacgtacgtaccccgtttagtacgggtacggttacggacgtacggggaaccgaagggtacgggaaacgtaacgaaaacgtaacgtacggtacggacgtcgacgacctaactcgttacgtcttacacgttccttacccggtcttaacg

SEQ ID NO: 418087 - DNA, 624 bp, Homo sapiens
  misc_feature: GZ8MTXP02GMMIM.2.25.C03.1.454.CMB.2.raw
  modified_base (201)..(201): a, c, t, g, unknown or other
  modified_base (244)..(244): a, c, t, g, unknown or other
  modified_base (257)..(257): a, c, t, g, unknown or other
  modified_base (280)..(280): a, c, t, g, unknown or other
  modified_base (286)..(286): a, c, t, g, unknown or other
  modified_base (310)..(310): a, c, t, g, unknown or other
  modified_base (420)..(420): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccaggggaaangccacctctcctgcagggccagtcagagtgtaccggcacgtangtagctggtaccngcagaactgcagctccagctctnatctgnggcatccagcgacggccccgcacncccgagacagtcaggtggcgaggtgggtctgggacaggtacgttcacgtctaccaataatcgaagacagtacgtggacgccgtagaacgtatttagctagttgttagttntagtacaaactaattacgtacgtaccgtaccccgttacgtacggtacggttaccgggaccggtaaacggggtaaccgtaaggggttacggaaaacgttaccggaaaaacggtaacgtacgggtcggtacgttacggaaccctaacctacggttcgttaccggttacctttacgtaccgtttacccttccccgtactttaacccg

SEQ ID NO: 418088 - DNA, 604 bp, Homo sapiens
  misc_feature: GZ8MTXP02JMOFX.2.25.C03.1.454.CMB.2.raw
  modified_base (203)..(203): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaagngccaccctctcctgcagggccagtcagagtgttaccggcacgtatgtagctggtaccagcagaacctggccaggctccagactcctcatctctgggcatccagcgacggcccccggcactccccagactacggttcagtggcacggtgggtcgtgggacgtagtagttcactcgtcacagtcgaagcaagtaccgtgacgccgtaggaacgtagttttcgacgttaaaggttgttaacgttttcgtacgttacaaaactagtaacgttcgtacgtcccccgtttagtcggtacgttacggaccgtaggtacgtaccaagggtacgtaacgtaacgaaacgaactggacgtcgtacggccctacaacgtcttcggttctactaccgttccgttacccgtacc

SEQ ID NO: 418089 - DNA, 750 bp, Homo sapiens
  misc_feature: GZ8MTXP02JLRED.2.25.C03.1.454.CMB.2.raw
  modified_base (202)..(202): a, c, t, g, unknown or other
  modified_base (240)..(240): a, c, t, g, unknown or other
  modified_base (320)..(320): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaangccaccctctcctgcagggccagtcagagtgttacggnacgtatgtagcctggtaccagcagaaacctggccaggctccagactcctcatctcgtgggcatccagcgacgggccccgnactcccagacgtgttacaagtggcaggtcggtcgtggaacagtagttcacgttctacgaactaactcgaacgacgaacgacgtgggaacgtccgtaaggtaaagttagtttaggacgtaaggtttcggtttaattttaccgagtttaaaccaaaagttaaacgttacgtttaccggttaaccgttaccccccgggtttaaggttaccggggtaacccggttttccgggggaacccgggtaacgggggtaaaacccggtaaagggggttaaacggtaaaacgggttaaaccgtaaaaacggggtaaccggttacggggttacgggaaccgtttaccggaaccggttaaaccctaacgtttcccggttaacggtttacccgtttaaccctaccggttttaacccctttaccccccggtaacgtttaaacccg

SEQ ID NO: 418090 - DNA, 696 bp, Homo sapiens
  misc_feature: GZ8MTXP02FO5R8.2.25.C03.1.454.CMB.2.raw
  modified_base (201)..(201): a, c, t, g, unknown or other
  modified_base (216)..(216): a, c, t, g, unknown or other
  modified_base (245)..(245): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctcgaggggaaancgcccaccctctccngcacgggccagtcagtagtcgttaccggnacgtatgtagcctggtaccagcaagaaacctggccgacggcctacccacgacctcctactatccgtcgtaggggccactccgacgccgaccgggcccccggcactcccgagacctaggtacagtggcacggtcggtgaggacagtagttcacgtctacaaacaacgtacgacgcgagtacgtggaccgtcgtagtaaagttgtttagactagttcggttatttacgtacgttaaactaaactaaacgttaacgtcccggttaaacccggttacccccgggtttaaggttccgggttaacccgggtttacgggacccggggaaacgggggtaaccccggtaaaggggtacggtaaaacgggtaaccgtaaaacgtaaacggtcgggtacggtactacggactaaccctagtccgttacgttccttaaccgtccgttcgtacccgtactacgg

SEQ ID NO: 418091 - DNA, 820 bp, Homo sapiens
  misc_feature: GZ8MTXP02JKETN.2.25.C03.1.454.CMB.2.raw
  modified_base (202)..(202): a, c, t, g, unknown or other
  modified_base (243)..(243): a, c, t, g, unknown or other
  modified_base (303)..(303): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaancgccaccctctcctgcagggccagtcagagtcgttaccggnacgtatgtagcctggtaccagcagaaacctggccaggctcccgagactcctcatcctcgnggggctagtcccgagccgacggggccccccggcacgtaccccaggacgtacgggttaccaggtcggacgacgggttggggtctcggggtaacaggtacggttccacgtcctacactaagttcgacgtacgtaacggtacgttacggacccggtacgttaagggtaacgttttacgtttacggtaccgttaggtttacgttttaacgtttaccgttaacggtaaaccctaaaaggttaacgtttacccggtttaacccggttaaccccccggttttaccccgggtttaaaccgggttaccgggtttaaccccggggttacccggggtaacccgggggtaaaaccggggttaaacccggggttaaagggggttaaccggttaaaacggtaaaaccggtaaaaacccggttgggtacggggtaccgttacggaccgtaacccggtaacccttaacggttcccgttaccggtttaaccgttaccttaaccggtttcccccgtacccttaaccggtttaccg

SEQ ID NO: 418092 - DNA, 684 bp, Homo sapiens
  misc_feature: GZ8MTXP02FGUYE.2.25.C03.1.454.CMB.2.raw
  modified_base (201)..(201): a, c, t, g, unknown or other
  modified_base (213)..(213): a, c, t, g, unknown or other
  modified_base (262)..(262): a, c, t, g, unknown or other
  modified_base (279)..(279): a, c, t, g, unknown or other
  modified_base (287)..(287): a, c, t, g, unknown or other
  modified_base (292)..(292): a, c, t, g, unknown or other
  modified_base (370)..(370): a, c, t, g, unknown or other
tcagacgctcgacacacgaccggtgctcgatttagtagtgtagatttgggtttggggagagctgctcagttaggacccagagggaaccatggaaaccccagcgcagcttctcttcctcctgctactctggctcccagataccaccggagagattggtgttgacgcagtctccaggcaccctgtctttgctcgaggggaaangccacctctccngcagggccagtcagagtgtacgcagtatgtagcctggaccagcagaacnggccagctccagactcncatctcgngggcntccagcgaccggccccgcactcccgagacgtaggttcgaggtcggcgtacggtgggtcgtagggacgtagtacgttcnctctacaactatacagacgacgtacgtcggacgtaccgtagtaagttagtttcgacgttagttacgtttactttacgtacgttaacctaaaacgtaaacttaacggttaccgttaacccggttacccccggtttaacgggttaccgggttaaccgggttaccgggacccgggtaacgggggaaaccggtaacggggtaacgggtaaaacggtaaccgtaaaacggtacgttacgggttacggacgttaccggaccgtaaccgttaacgtcgttaacggttccttacgtaccgtttaccgtacccgtactaaccg

SEQ ID NO: 418093 - DNA, 649 bp, Homo sapiens
  misc_feature: GZ8MTXP02HFEVW.2.25.C03.1.454.CMB.2.raw
  modified_base (203)..(203): a, c, t, g, unknown or other
  modified_base (241)..(241): a, c, t, g, unknown or other
  modified_base (295)..(295): a, c, t, g, unknown or other
  modified_base (343)..(343): a, c, t, g, unknown or other
  modified_base (352)..(352): a, c, t, g, unknown or other
tcagacgctcgacacacgaccggtgctcgatttagtagtgtagatttgggtttgggggagagctgctcagttaggacccagagggaaccatggaaaccccagcgcagcttctcttcctcctgctactctggctcccagataccaccggagagattgtgttgacgcagtctccaggcaccctgtctttgtctccgaggggaaanagccacctctcctgcagggccagtcagagtgttacggnacgtatgtagcctggtaccagcaacgaaacctggccaggcctccagacctcctnactctcgtgggcacgtcacgccgacgggcccccgcacgtacccagacncggttacgnggtcggcgacggtcgggtcgaggggacaggtaacgttcaccgtcctaacgaaactaacacgacgacgaacgacggttggaccgtacgtaaggttaagttacgtttagacgttaggtttactttaacgtttctacggtaaactaaactaagtaccgttacgtacccgttacccggttacggtcggttaccggtcggaacgggtacgggaccggtaaggtacggaacgtaaacgaaacgtacggttacggacgtacgtcgacctactacgtcgtcttactctactccgtaccgtctacg

SEQ ID NO: 418094 - DNA, 539 bp, Homo sapiens
  misc_feature: GZ8MTXP01CY0XT.9.86.H09.1.454.CMB.2.raw
  modified_base (227)..(227): a, c, t, g, unknown or other
  modified_base (512)..(512): a, c, t, g, unknown or other
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctctgcactggaaccngcattgggattttacctgtctctgtacacacaccagcaagccccaaatcatgatttatgaagtcactaagcggccctcggggatttctgctcgtcttctctggcctccaagtccgtcaacaaccggcctccctgacaatctctgggctccagactgaggacgaggctactatttattactgttgctcatagtacgtaggttagtaagttaggttgggtgttcgggcggagggtacaaggctggaaccgtcagggtcagcccgaaggccgcgcccccgtggtaccncgtctccgttcccgtcccttcctaacg

SEQ ID NO: 418095 - DNA, 588 bp, Homo sapiens
  misc_feature: GZ8MTXP01CBBCC.9.86.H09.1.454.CMB.2.raw
  modified_base (296)..(296): a, c, t, g, unknown or other
  modified_base (528)..(528): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagctagttgggtattttacctgtctctgtaccacaccaccaggacaacgccccaaatcatgatttangaagtcacgtaagccggtcctcggggtatttcgtgctcgtcttctctcggtccctccaacgtcccgtacaaccgaacccggccctccgtcgaactactcgtacgtcgggctccgagtacgtggacggacgaggtcttacgtatttacttactgttcgcttacacttagtacgtaggtgttaaggtagttgggtgtggacgggaggtacaagcgtacgccggtcgttaggtcncgtaccgacgccgttccgaccccgttcggctcctcgtccgttcccgtccgttccgtaacg

SEQ ID NO: 418096 - DNA, 598 bp, Homo sapiens
  misc_feature: GZ8MTXP01EFHN5.9.86.H09.1.454.CMB.2.raw
  modified_base (228)..(228): a, c, t, g, unknown or other
  modified_base (286)..(286): a, c, t, g, unknown or other
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccngcattgggatttaacctgtctctggtacacacaccagcaagccccaaatcatgattangaagtcactaagcgcctggggatttctgctcgcttctctggccctccaaacgtcccgtcaaccgaaccggccctccctagaactaactcctctggggctccgagactggaggacgaggctacgtatttattactgttgctacatagtacgaggttagttaagtagttggggtgttcgggacggtaagggaccaaaggtcgtcggaacccgtcgttaggggtcacggccccgtaaaggcccgttccggccccccgttcgggtaccctaaccgtttcccggtcgttcccccgtaaccccgttcccttaacccgg

SEQ ID NO: 418097 - DNA, 606 bp, Homo sapiens
  misc_feature: GZ8MTXP01AHUYS.9.86.H09.1.454.CMB.2.raw
  modified_base (299)..(299): a, c, t, g, unknown or other
  modified_base (331)..(331): a, c, t, g, unknown or other
  modified_base (341)..(341): a, c, t, g, unknown or other
  modified_base (371)..(371): a, c, t, g, unknown or other
  modified_base (422)..(422): a, c, t, g, unknown or other
tcagtgatacgtctcacgaccggtgctcgatttagtgctatagacttgggtttgggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcacatctcctgcactggaaccagctagttgggtattttaacctgtctcctggtaccaacaccacccaggcaaacgcccccaaatcatcgatttanagaagtcacgtaagcggccctcggggatttcngctcgcttcnctggcctcagtccgtcaacacggccctccngacaatctctgggctcagactggaggacgaggctctattattacgtgttcnctactaatagtacgagttgtaaggtagttgggtgttcggacgggaggtaccgaaggtcgtaggaacccggttccgttaagggtccgacgaccccgtaaaggggttccctttccggccccccgttaaggggttccctaacccgttcctttaccggttccccctaacccttcccggtttaaccccg

SEQ ID NO: 418098 - DNA, 552 bp, Homo sapiens
  misc_feature: GZ8MTXP01BHF0E.9.86.H09.1.454.CMB.2.raw
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttacctgtctctggtaccacaccaccaggcaaagcccccaaactcatgatttatgaagtcactaagcggccctcggggatttctgctcgcttctctggcctccaagtccgtcaacaaccggcctccctgaccaatctctgggctccagactggacggacgaggctcattattactgttgctactatagtactaggttagtaaggttagttggggtgttcgggcgggtagggtaccaaggctggaaccgtcgttaggtcagcccgaagccgttcgccccctggtcaactcctcgttccctaacccttctaaccg

SEQ ID NO: 418099 - DNA, 608 bp, Homo sapiens
  misc_feature: GZ8MTXP01EB0SU.9.86.H09.1.454.CMB.2.raw
  modified_base (218)..(218): a, c, t, g, unknown or other
  modified_base (455)..(455): a, c, t, g, unknown or other
tcagtgatacgtctcacgaccggtgctcgatttagtgctatagacgtttggggtttgggggggggtcacaagaggcagcgctctcgggacgtctccaccatggcctgggctctgctgctccgtcaccctcctcactcaggacgcagggtcctgggccagtctgccctgactcagcctgcctccgtgtctgcgtctcctggacagtcgatcacatctcngcactggaaccagctaagttgggtattttaacctgtctctaggtaccaacaccaccagacaaacgaccccaaatcactgaattatagaaagtcagtaacgcgaccgtgggtatttctgctcgcttcgtctcggccctaccaagtcccgtacaaaccgtaccggtccttcccgagaaaccaacttccgtcgtcgggctaccgagtacgtggacggacgagtctacgtattaactcgtnctcgactatagtagtcgacgagtacgtcgtcgtaaccgtccgttccggtaggtacgtccggggacggtaacggaacgttaaagggtccgttaccgtcgtaacggcgacgaccgtaacgtcctcccggtcccgtgttacctccgttcgtaaccg

SEQ ID NO: 418100 - DNA, 659 bp, Homo sapiens
  misc_feature: GZ8MTXP01AY1LQ.9.86.H09.1.454.CMB.2.raw
  modified_base (297)..(297): a, c, t, g, unknown or other
  modified_base (330)..(330): a, c, t, g, unknown or other
  modified_base (457)..(457): a, c, t, g, unknown or other
tcagtgatacgtctcacgaccggtgctcgatttagtgctatagacttgggtttgggggggggtcacaagaggcagcgctctcgggacgtctccaccatggcctgggctctgctgcctccccaccctcctcactcaggacgcagggtcctgggcccagtctgccctgactcagcctgcctccgtgtctgcgtctcctggacagtcgatcaccatctcctgcactggaaccagctagttgggtattttacctgtctctgtaccaacaccaccagacaaacgccccaaatcatgtattanagaatcaactaacgcggtcccgtgggtatttcngctcgtcttctcgtggcctacccgaacgtccgtacaaaccgtaccggtcccctccctgaacctaatccgtaccgtgggcctacgacgtactggaaggacgaggtctacgtaattacttactggttcnccttataattacgtaagggtaagggttaggttaaaggttagggttggggtcggttacggggacggtaacggggaccctaaggtccgtcggaccgtcgtaacgggttcacggacccgtaacggtccgttcccggcccccgttcgggtaacctaccctttccgttcccggttacccccttaacccttccgttaaccgtaaccgg

SEQ ID NO: 418101 - DNA, 529 bp, Homo sapiens
  misc_feature: GZ8MTXP01CF26W.9.86.H09.1.454.CMB.2.raw
  modified_base (229)..(229): a, c, t, g, unknown or other
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccngcattgggattttaacctgtctcctggtaccaacaccacccaggcaaagcccccaaactcatgatttatgaagtcactaagcggccctcgggggatttctgctcgcttctctggcctccagtcccgtcaacacggcctccctgacaatctctggggctccagactgaggacgaggctcattatactgttgctcatatacaggtgtaagtagttgggtgttcggcggagggaccagctgaaccgtcaggtcagcccaaggcttcgccccctggtcaactctcgttccccaacccttcctcg

SEQ ID NO: 418102 - DNA, 533 bp, Homo sapiens
  misc_feature: GZ8MTXP01AGW7Z.9.86.H09.1.454.CMB.2.raw
  modified_base (231)..(231): a, c, t, g, unknown or other
  modified_base (300)..(300): a, c, t, g, unknown or other
  modified_base (429)..(429): a, c, t, g, unknown or other
  modified_base (516)..(516): a, c, t, g, unknown or other
  modified_base (528)..(528): a, c, t, g, unknown or other
tcagtgatacgtctcacgaccggtgctcgatttagtgctatagacttggggtttggggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctccgtggacagtcgatcacatctcctgcactggaaccngctagttgggtattttaactgtctctggtaccaacaccaccaggacaaacgccccaaatcatgatttangaagtcactaagcgccgtcggggtatttctggctcgtcttctctcggtcctccagtccgtacaaacaccggcctccctgacaatctctgggctccagactgaggacgagctactattattactggttcnctatatagtagtaggttagtaagttggtggtgtcggacggacggtacagtcgcgtcgtcgttagcacgccgagcgttccgccctgcnctctcttcctcnccgtc

SEQ ID NO: 418103 - DNA, 567 bp, Homo sapiens
  misc_feature: GZ8MTXP01B8LX8.9.86.H09.1.454.CMB.2.raw
  modified_base (226)..(226): a, c, t, g, unknown or other
  modified_base (298)..(298): a, c, t, g, unknown or other
  modified_base (420)..(420): a, c, t, g, unknown or other
tcagtgatacgtctcacgaccggtgctcgatttagtgctatagacttggggtttggggggggtcacaagaggcagcgctctcggacgtctccaccatggcctgggctctgctgctcctcaccctcctcactcaggacgcagggtcctgggcccagtctgccctgactcagcctgcctcgtgtctgcgtctcctggacagtcgatcacatctctgcacgtggaaccngctagttggggtattttaacctgtctcctggtaccaacaccaccaggacaaacgcccaaactcatgtattanagaatcaacgtaacgccggccgtacggggtatttctggctcgtcttctctcggccctacagtccgtacaacgaaccgccctccagaacaatctcgtcgggctaccagacaggacgagacgtntactattaatctagttcactatatagtagtaggtagtaagtaggtggtgtcggacggacgggacctaagctggaaccgtcttaggccacgacccgtagccgttccgcccctaacggtcaaccgtctccgttcccctccgttccaacg

SEQ ID NO: 418104 - DNA, 589 bp, Homo sapiens
  misc_feature: GZ8MTXP01BFIPW.9.86.H09.1.454.CMB.2.raw
  modified_base (304)..(304): a, c, t, g, unknown or other
  modified_base (431)..(431): a, c, t, g, unknown or other
  modified_base (453)..(453): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagctagtttggggtattttaacctgtctctggtaccaacaccaccaggacaaacgccccaaactcatgtatttanagaagtacactaacgcggcccgtcgggggtatttctgctcgtcttctctggccctccgaacgtccgtacaaccgaacccggccctccctgactaactctcgtcgggcttccagtacgtggaggacgnggcttactatttattactgttnctactatagtacgtaggtgtaaggttagttggggtgttcggacgggacggtaccgagtctggaaccgtcgttaggtcacgacccgaaggcgttccgccccgtggtcctcttcctcgttccccaaccgttctaaccg

SEQ ID NO: 418105 - DNA, 619 bp, Homo sapiens
  misc_feature: GZ8MTXP01AI62F.9.86.H09.1.454.CMB.2.raw
  modified_base (303)..(303): a, c, t, g, unknown or other
  modified_base (482)..(482): a, c, t, g, unknown or other
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatccacatctcctgcactggaaccagctagttggggtatttttaacctgtctcctggtaccaacaccaccaggacaaacgccccaaatcatgtatttangaagtcactaagccggccctcgggggtatttctgctcgtctttctcgtacggtccctaccgtaacgtcccgtaccaaccgaacccgggtccctcccgtagtaacctaaacttcgtccgtcggggcctacccgagtacgtaggaacggacgacggtactacgtaatttacttacgtgttnctacatacgtacgtaggtgtaaggttagttgggtgttcgggacggtacggactaggctcgtaacccgtcgttggtacacgtaccgaacggcgttcgccccgtcggtctcttcctcggttcccctccttccgtaaccg

SEQ ID NO: 418106 - DNA, 663 bp, Homo sapiens
  misc_feature: GZ8MTXP01B8UEO.9.86.H09.1.454.CMB.2.raw
  modified_base (230)..(230): a, c, t, g, unknown or other
  modified_base (293)..(293): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccngcagttgggtattttacctgtctctgtacacaccaccagacaacgccccaaatcatgtattangaagtcactaacgcggcccgtgggggtatttctgtctcgtcttctctcggtccctccgtaaacgtcccgtaccaaccgaacccgggtccctcccgtagaactaaaccgtccttcgtcggggtccttacccgaggtaccttagggaacgggacgtacgggtcttacgtaacgtttatttaccgtgttcgacttactaagttagtagtaagggttagtaaaggttggtttagggtcgttcggggtacgggacggtaacgaaggtctcggtaacccgttcgacggtccacggtacccgtaacggttccgttcccggttcccccgttcggtaccctccgttcctccggttccccctaaccccgttccttaaccg

SEQ ID NO: 418107 - DNA, 594 bp, Homo sapiens
  misc_feature: GZ8MTXP01DM95C.9.86.H09.1.454.CMB.2.raw
  modified_base (214)..(214): a, c, t, g, unknown or other
  modified_base (226)..(226): a, c, t, g, unknown or other
  modified_base (567)..(567): a, c, t, g, unknown or other
tcagtgatacgtctcacgaccggtgctcgatttagtgctatagacttggggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcatcacatctcngcactggaaccngcagttgggtatttacctgtctctgtacacaccaccaggcaaacgccccaaactcatgattatgaagtcaactaagcggccctggggtatttctcgctcgtcttctcgtcggccctaccgaaagtcccgtacaaacgaaccggtccctcccgtagaacctaattcctcgtcggggccttaccgagtactaggacggacgacggctacctatttattactgttacgcttctaattaagtacgtaagggtgttaaaggttaggttgggtgttcgggacggtagggaccaagtctgtaacccgtcgttaggtcagacccgtaagccgttccgccccgtggtccncttctcgttccccaacccttcgaaccg

SEQ ID NO: 418108 - DNA, 668 bp, Homo sapiens
  misc_feature: GZ8MTXP01A5LZH.9.86.H09.1.454.CMB.2.raw
  modified_base (300)..(300): a, c, t, g, unknown or other
  modified_base (387)..(387): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagctagttgggtattttaacctgtctctgtaccaacaccaccaggcaaacgccccaaactcatgtatttanagaagtcaacgtaagccggcccgtcggggtatttcgtgtcctcgtcttctctcggccctccaagtccgtacaccaaccggccctccngaactactctcgtcgggctaccgagtacgtaggacggacgacggtcttactatttaacgttactgttacgctactaattagtacgtagggtttaggtaaaggttaggggtttcgggtaggtttaccggggacggggtaacgggtaacctaacgggtctaccgggtaacccggttcgttaacgggtacccgacggtcccgtaaacggcccgttacccggttcccccgttaaccggtcctaacccgtccgttacccggttcccctccccttaaccgtaacccg

SEQ ID NO: 418109 - DNA, 621 bp, Homo sapiens
  misc_feature: GZ8MTXP01EHBTO.9.86.H09.1.454.CMB.2.raw
  modified_base (227)..(227): a, c, t, g, unknown or other
  modified_base (289)..(289): a, c, t, g, unknown or other
  modified_base (328)..(328): a, c, t, g, unknown or other
  modified_base (367)..(367): a, c, t, g, unknown or other
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcacatctctgcactggaaccngctagttgggtatttactgtctctggtacacaccaccaggcaacgccccaaatcatgattanagaatcactaagcgccgtgggtatttcgtgctcgcttcnctcgcctccaagtccgtacaacgaaccggccctcccgtnaactaactcctacgtcgggcctaccagacctagggacggacgtacggactactaatttacttaacgttgttcgacttacgtaattaaggttaacgtaggggttaagttaagggttaggttggggtacggttcgggacgggtacggtaaccagtcgtcggtaaaccgttcgttaacggtcacggacccgaacggttccgttacccgccccgtgggtcctaaccgttccgtccgttccccgtcccttcgtaaccgg

SEQ ID NO: 418110 - DNA, 724 bp, Homo sapiens
  misc_feature: GZ8MTXP01CO4MF.9.86.H09.1.454.CMB.2.raw
  modified_base (233)..(233): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctccgtggacagtcgatcactatctcctgcactacggaaccngactagttgggttacttttaacctgtcctcgtacgtaaccaacacccaccgagaccaaacgaccccaaatcgatagtaatttagagtaacgtacaacgtaacggccggtaccgtcgggtactttccgcgtccttcgttaccttcgtacgtcggtaccccgttaccgtaacgtccgtaaccaacccgtaacccgggtccccttcccgtagtaaccctaaacgttccgttaccggcgggtaccctaccgaagtcgacggacggtacgacgtcctaataatttacgttacgtgtacgtactattaatacggttaaagttaggggttaagttaaggggttaggtttgggggtcggttaccggggaacggacgggtaacctaacggtcgtcggtaacccggtttacgagggtaccaaccgtacccgtaacggttcccgttccgttacccccgttggacccttccgttcctccgtttaccccaacccgttctaaccg

SEQ ID NO: 418111 - DNA, 621 bp, Homo sapiens
  misc_feature: GZ8MTXP01EQCEK.9.86.H09.1.454.CMB.2.raw
  modified_base (290)..(290): a, c, t, g, unknown or other
  modified_base (299)..(299): a, c, t, g, unknown or other
  modified_base (306)..(306): a, c, t, g, unknown or other
  modified_base (583)..(583): a, c, t, g, unknown or other
tcagtgatacgtctcacgaccggtgctcgatttagtgctatagacttggggtttggggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactaggaaccagctagttgggtattttacttgtctcgtacgtacacaccacccagacaacgacccaatnatgtattanagatcanaacgcgtccgtgggtatttctgtctcgtcttcgtctcggtcccctaccgaaacgtcccgtaccaacgaaacccggtccctcccgtagaaacctacttccgtacggtccgggtactacccgagtacgtacggacggacggagtctaactaattttactacgttgttcgctacgattacgtaagtagggttagtaggttaggttcgggtggttacggacggtacgctaagcgtacggaacctgttacggcacgtaccgaagccgttccgttaccccgtntaccgtcctccgttccttacccgtccccttcgtaaccg

SEQ ID NO: 418112 - DNA, 697 bp, Homo sapiens
  misc_feature: GZ8MTXP01DN01R.9.86.H09.1.454.CMB.2.raw
  modified_base (234)..(234): a, c, t, g, unknown or other
  modified_base (305)..(305): a, c, t, g, unknown or other
  modified_base (678)..(678): a, c, t, g, unknown or other
tcagtgatacgtctcacgaccggtgctcgatttagtgctatagacttggggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcatccacctatcctcctgcacgtaggaaccngctagttgggtattttaacctgtctctcgtaccacaccaccacgacaaacgccccaaactcatgtatttanagaacgtacaacgtaacgtccggtaccgtcgggtatttccgtcgtccgttcgtcttctcgtccgtccctaccgtaaacgtcccgtaaccaaccggtaacccgtcccttaacccgtagtaacctaaacgttcgtacgtcgggtacctaccagacgtaggaacggacgtacgtactactatttacttacgtgttcgacttacgtaattaacgtaacggtagggttaagttaaagggttgggtttgggtcggttacgggggaacgggtacggtaacgtaaggtccgtacgggtaaccgtcgttacggccaaccggtaccgtacggttcccgttcccggttaccccgtggtacctaaccgttccgtcccgttacccnccccgtttaacgtaaccgg

SEQ ID NO: 418113 - DNA, 508 bp, Homo sapiens
  misc_feature: GZ8MTXP02JVIEI.9.86.H09.1.454.CMB.2.raw
  modified_base (302)..(302): a, c, t, g, unknown or other
  modified_base (412)..(412): a, c, t, g, unknown or other
  modified_base (424)..(424): a, c, t, g, unknown or other
tcagtgatacgtctcacgaccggtgctcgatttagtgctatagacttgggtttgggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagtgatgttgggagttatgaccttgtctcctggtaccaacagcacccaggcaaagcccccaaactcatcatttangaggtcactaagcggccctcgaggggtttctattccgcttctctggctccaagtctgacaacacgcctccctgacatctctgggctccaggctgaggacgaggctgattnttactgctgctnatatgcagatggtgacactcccggtggtacttcgggcggacgggaccaaggtcgaaccgtcctaggtcacgcccaaggctccgg

SEQ ID NO: 418114 - DNA, 537 bp, Homo sapiens
  misc_feature: GZ8MTXP02I933R.9.86.H09.1.454.CMB.2.raw
  modified_base (409)..(409): a, c, t, g, unknown or other
tcagtgatacgtctcacgaccggtgctcgatttagtgctatagacttgggtttggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctctgtaccaacacaccagcaagccccaaatcatgatttatgaagtcactaagcggcctcggggatttctgctcgcttctctggcctccaagtccgtacaacaccggcctccctgacaatctctgggctccagactgaggacgaggctcattattactgttcnctacatatacgtagtagttaaggttagttgggtggtcgggacgggacggacgagcgtacgaccgtcgtaggcacgaccgacgcctccgccccgtcgtcctacttccgtccgtacccacccgtcctacg

SEQ ID NO: 418115 - DNA, 504 bp, Homo sapiens
  misc_feature: GZ8MTXP02GHZZF.9.86.H09.1.454.CMB.2.raw
  modified_base (283)..(283): a, c, t, g, unknown or other
  modified_base (312)..(312): a, c, t, g, unknown or other
  modified_base (415)..(415): a, c, t, g, unknown or other
  modified_base (436)..(436): a, c, t, g, unknown or other
tcagtgatacgtctcacgaccggtgctcgatttagtgctatagacttgggtttggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggatttacctgtctctgtacacacaccagcaagccccaaatcatgatttangaagtcactaagcggcctcggggatttcngctcgcttctctggcctccaagtccgtcaacacggcctccctgacaatctctgggctcccagactgagacgaggctcattatactgttgctcatatacaggtntaagtagttgggtgttcgggnggtagggaccaagctgacgtcgtaggtcagccctaagctcgcccctgcactctcgtcccacctctacg

SEQ ID NO: 418116 - DNA, 548 bp, Homo sapiens
  misc_feature: GZ8MTXP02JFC5L.9.86.H09.1.454.CMB.2.raw
  modified_base (538)..(538): a, c, t, g, unknown or other
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggattttaacctgtctctggtaccaacaccaccaggcaaacgcccccaaatccatgatttatgaagtcactaagcggccctcggggatttctgctcgcttctctggcctccaagtccgtacaacacggcctccctgacaatctcgtgggcctcagactgaggacgaggctacattattactgtgctcatatactaggtgtaagtagttggggtgttcgggcggtaggaccaaggtctacggaaccgtccgtaggaccgacgacccgaaggcctcgccccctggtcaccgttctcggttccccnccctctaccg

SEQ ID NO: 418117 - DNA, 527 bp, Homo sapiens
  misc_feature: GZ8MTXP02JLJLM.9.86.H09.1.454.CMB.2.raw
  modified_base (332)..(332): a, c, t, g, unknown or other
tcagtgatacgtctcacgaccggtgctcgatttagtgctatagacttgggtttgggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctctggtaccaacaccaccaggcaaacgcccccaaatcatgatttatgaagtcactaagcggcctggggatttctgctcgcttcnctggcctccaagtccgtacaacacggcctccctgacaatctctgggctccagactgaggacgaggctacattattactgttgctcatatacagtgtagtagtggtgtcggaggaggaccaagctgaccgtctaggtcacggtccaacggctcgccccgtaaggtcaaccgttctacgttccccacccttctaccg

SEQ ID NO: 418118 - DNA, 541 bp, Homo sapiens
  misc_feature: GZ8MTXP02JZZOA.9.86.H09.1.454.CMB.2.raw
  modified_base (375)..(375): a, c, t, g, unknown or other
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctctgtaccaacaccaccaggcaaacgcccccaaactcatgatttatgaagtcactaagcggccctggggatttctgctcgcttctctggccctccaagtccgtacacacggcctccctgacaatcnctgggctccagactgaggacgagctcattattactgttgctcatatacgaggtgtaaggtagttgggtagttcgggcggagggtaccaaggctaggaccgtcgtaggtcacgcccgaaggcctccgccccctcggtccacgttctacgttccccacccgttctacg

SEQ ID NO: 418119 - DNA, 585 bp, Homo sapiens
  misc_feature: GZ8MTXP02GXMNM.9.86.H09.1.454.CMB.2.raw
  modified_base (424)..(424): a, c, t, g, unknown or other
tcagtgatacgtctcacgaccggtgctcgatttagtgctatagacttgggtttgggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggtattttacctgtctctgtaccaacaccaccagcaacgccccaaactcatgatttatgaagtcactaagccggcctcggggtatttctgctcgtcttctctggcctccaagtccgtacaacaccggcctccctcgactaactcctcgtcgggcctccagactgagacgaggctctattattactgtcgntacatatactaggtagtaagtagttgggttagttcgggcgggaacgggacaaaggcgtacgtaccggttaccgtacggtacgcggacccgaacggtccgtccgtccccccgtcgggtcctaccttccgttcccggttcccccgtccccgtttcctaacccg

SEQ ID NO: 418120 - DNA, 564 bp, Homo sapiens
  misc_feature: GZ8MTXP02G4QQ5.9.86.H09.1.454.CMB.2.raw
  modified_base (261)..(261): a, c, t, g, unknown or other
  modified_base (292)..(292): a, c, t, g, unknown or other
  modified_base (387)..(387): a, c, t, g, unknown or other
  modified_base (404)..(404): a, c, t, g, unknown or other
tcagtgatacgtctcacgaccggtgctcgatttagtgctatagacttgggtttgggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctctggtaccaacnccaccagcaaacgcccccaatcatgatttangaagtcactaagcgcctggggatttctgctcgcttctctggccctcaagtccgtacaacacggcctcctgacaatctctggctcagctgagacgngctacattatactgttnctacatatacgaggtagtaaggtagttcgggtgttacgggcgggagggtaccaaggctacggtaccgttccgtagggtccaacggacccgaacggccctccggaccccccgttgggtaccctaccggttccttccggtttacccccacccttccctaccg

SEQ ID NO: 418121 - DNA, 542 bp, Homo sapiens
  misc_feature: GZ8MTXP02I1IVO.9.86.H09.1.454.CMB.2.raw
  modified_base (276)..(276): a, c, t, g, unknown or other
  modified_base (362)..(362): a, c, t, g, unknown or other
  modified_base (425)..(425): a, c, t, g, unknown or other
  modified_base (429)..(429): a, c, t, g, unknown or other
tcagtgatacgtctcacgaccggtgctcgatttagtgctatagacttggggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagctattgggattttaacctgtctctgtaccaacaccaccagcaaacnccccaaatcatgatttatgaatcactaacgccgccgtcggggtatttcgtgctcgcttctctaggccctaccacgtcctacaaacnccggcctcctgacaactctcgtggctaccagactgaggacgaggtctcaatttatactgttcnctanataatacgtagtagtagttgttggtgtcggaggacgacgaagcgtacgtaccgtcgtagcacgaccgacgcctccgccctcggtactaccgttcctcgtacccaccttcgtac

SEQ ID NO: 418122 - DNA, 585 bp, Homo sapiens
  misc_feature: GZ8MTXP02JBHT3.9.86.H09.1.454.CMB.2.raw
  modified_base (228)..(228): a, c, t, g, unknown or other
  modified_base (291)..(291): a, c, t, g, unknown or other
  modified_base (318)..(318): a, c, t, g, unknown or other
  modified_base (324)..(324): a, c, t, g, unknown or other
  modified_base (328)..(328): a, c, t, g, unknown or other
  modified_base (369)..(369): a, c, t, g, unknown or other
  modified_base (417)..(417): a, c, t, g, unknown or other
  modified_base (553)..(553): a, c, t, g, unknown or other
tcagtgatacgtctcacgaccggtgctcgatttagtgctatagacttggggtttgggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccngcattgggattttaacctgtctctggtaccaacaccaccagcaagccccaaatcatgatttangaagtcactaagcgcctggggatttcngctcgnttcnctgcctcaacgtccgtacaacaccggcctcctgacaactcnctcggctcagactgacggacgaggtctacgactttattacgtggttcncttaccaattactaacgtggttaagttaaggttaggttgggtgtttcgggcgggtaaggaaccgaagtcgtacggaaccgttccgtaagggccaaacggccccgtaaagggccctcggtacccccctgggtacccnccttcgtcgttcccccgtccttcccgtaaccg

SEQ ID NO: 418123 - DNA, 618 bp, Homo sapiens
  misc_feature: GZ8MTXP02G8BAB.9.86.H09.1.454.CMB.2.raw
  modified_base (210)..(210): a, c, t, g, unknown or other
  modified_base (228)..(228): a, c, t, g, unknown or other
  modified_base (294)..(294): a, c, t, g, unknown or other
  modified_base (350)..(350): a, c, t, g, unknown or other
  modified_base (365)..(365): a, c, t, g, unknown or other
  modified_base (415)..(415): a, c, t, g, unknown or other
tcagtgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccntctcctgcactggaaccngcattgggagttttaacctgtctctgtaccacaccaccagcaaacgcccccaaactcatgatttangaatcactaagcgcctcggggtatttctcgctcgcttctctggtcctccaagtccncacacggcctccgtnacactctacgtggactccagctgaggacgagctcattacttacgtgttcnctatactaagtacgtaggttagttaaaggttggtttagggggtagtttccggggacggggtaacggggaaccgtaaacggcgttacggtaacccggtcgttaaggggtacctaaccggggacccctaaacggtccgttaccggccccccgttcggtacctaaccgtttccgtacccggtttcccccgtccccttcccgtaacg

SEQ ID NO: 418124 - DNA, 572 bp, Homo sapiens
  misc_feature: GZ8MTXP02GTX58.9.86.H09.1.454.CMB.2.raw
  modified_base (332)..(332): a, c, t, g, unknown or other
  modified_base (425)..(425): a, c, t, g, unknown or other
  modified_base (429)..(429): a, c, t, g, unknown or other
tcagtgatacgtctcacgaccggtgctcgatttagtgctatagacttgggtttgggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcagttgggtattttaacctgtctctggtaccaacaccaccagacaaacgccccaaatcatgatttatagaagtcaactaagccggccgtacggggtatttcngctcgcttctctgccctccaagtccgtacaacaccgcctccctgacaatcctcgtcggctaccagactggagacgagctacattagtactgtnctanatatacgtaggtagtaaggttagtgggtgttacgggcggaggaccaagctacgaccgtcgttaggccacggaccccgaaggtccctacccgcccccgtcggtacctacgttccgtacccgtaccccctaaccctccgtaaccg

SEQ ID NO: 418125 - DNA, 543 bp, Homo sapiens
  misc_feature: GZ8MTXP01DKV8O.9.1.A01.1.454.CMB.2.raw
  modified_base (267)..(267): a, c, t, g, unknown or other
  modified_base (335)..(335): a, c, t, g, unknown or other
  modified_base (428)..(428): a, c, t, g, unknown or other
tcagtgatacgtctcacgaccggtgctcgatttagacgtctcatcaaggaagggaagggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctctggtancaacaacaccaggcaaagcccccaatcattatttctgatgtacaacaatcggacccccagggatttcngatcgccttctctggctcccaaaagtcctggcaaacaccggcctccctgaccatctcgtgggcctcggggctgaggacgagctcactattacngcagtctcataactaacaacacgacgactactctgttggtcggtcggaggacgttacgtacgtacgttaccgttcgttacgtcgacgaaccgacgcgttccgtcccgttccgtcg

SEQ ID NO: 418126 - DNA, 553 bp, Homo sapiens
  misc_feature: GZ8MTXP01AMRXK.9.1.A01.1.454.CMB.2.raw
  modified_base (248)..(248): a, c, t, g, unknown or other
  modified_base (272)..(272): a, c, t, g, unknown or other
  modified_base (500)..(500): a, c, t, g, unknown or other
  modified_base (536)..(536): a, c, t, g, unknown or other
tcagtgatacgtctcacgaccggtgctcgatttagacgtctcatcaaggaagggaagggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttgggtncttaataattatgtctcctggtancaacaacacccaggccaaacgccccccaactcattatttctgatgtacaacatccggcccccagggtactttctgatcgtccttctctggctccaaagtctggcaacacggccctcctgaccatctcgtgggcttcccggggctaggagggtacgagggcctacacttattactggacagcttacatactacaacgagcgactctcgtgttgtcgggcggagggtacngaactgaccgttccgttaggtcacgccgaaggtccncgtcccccgttggtccc

SEQ ID NO: 418127 - DNA, 576 bp, Homo sapiens
  misc_feature: GZ8MTXP01EAM5N.9.1.A01.1.454.CMB.2.raw
tcagtgatacgtctcacgaccggtgctcgatttagacgtctcatcaaggaagggaaggggggagaggagccccagccttgggattcccaagtgttttcattcagtgatcaggactgaacacagaggactcaccatggagtttgggctgagctggattttccttgctgctattttaaaaggtgtccagtgtgaggtgcaactgggtggagtcgtgggggagctcgggtcaagcctggggatcccttagactctcctgtgcaacctctggattcaatttcgacatcgcctggatgagttgggccccgcaggctccgagggaggggctggagtggggttggacgttcgtaaaaggcaaagggtagcggtgggaccaggcaaggcctacggcttcaagtcccgtggaaacgggcaaggattcaagcatttccagagacgatagacaagacagatgatgatttacagatagaacagacctaaaatacggaataacacacgtcctaattacttcgtcttcgtcttacttacgttcgacgtaagtggtaacgttcgttccggttacgggtcggttcggtaacg

SEQ ID NO: 418128 - DNA, 530 bp, Homo sapiens
  misc_feature: GZ8MTXP01CD09C.9.1.A01.1.454.CMB.2.raw
  modified_base (232)..(232): a, c, t, g, unknown or other
  modified_base (244)..(244): a, c, t, g, unknown or other
  modified_base (440)..(440): a, c, t, g, unknown or other
  modified_base (470)..(470): a, c, t, g, unknown or other
  modified_base (476)..(476): a, c, t, g, unknown or other
  modified_base (482)..(482): a, c, t, g, unknown or other
  modified_base (489)..(489): a, c, t, g, unknown or other
tcagtgatacgtctcacgaccggtgctcgatttagacgtctcatcaaaggaagggaagggggggtctcaggaggcagcgctctcgggacgtctccaccatggcctgggctctgctattcctcaccctcctcactcagggcacagggtcttgggcccagtctgccctgactcagcctgcctcgtgtctgggtctcctggacagtcgatagccatctcctgcactggaactaangtgacgttggtnctttaataattatgtctcctggtatcaacaacacccaggcaaacgccccccaatcattactttctgatgtacaacaatcgggcccccagggtactttcgtgacttcggcctttctcgtggcctcccgaaaaggttcctgggaccaaacgaccggccctccctgaccatctctgggctcgggctggaggacgaggcncactattactgcagctcatacacacagcanactctntgtcgnggaggcngaactgccgttcaggtcacgccaaggtcttcgccccttgcc

SEQ ID NO: 418129 - DNA, 693 bp, Homo sapiens
  misc_feature: GZ8MTXP01C8PNX.9.1.A01.1.454.CMB.2.raw
  modified_base (235)..(235): a, c, t, g, unknown or other
  modified_base (246)..(246): a, c, t, g, unknown or other
  modified_base (267)..(267): a, c, t, g, unknown or other
  modified_base (310)..(310): a, c, t, g, unknown or other
  modified_base (560)..(560): a, c, t, g, unknown or other
tcagtgatacgtctcacgaccggtgctcgatttagacgtctcatcaagggaagggaagggggggggtcgtcaggaggcagcgctctcgggacgtctccaccatggcctgggctctgctattcctcaccctcctcactcagggcacgagggtcttgggcccagtctgccctgactcagcctgcctcgtgtctgggtctcctggacagtcgatacgccatctctgcactgaaactangtgacgttggncttaatattatgtctctgtanacaacaacaccagacaaacgcccccaactctattattctgatntacgaacaacgtcccggacccccagggtactttcgtgtactccgtccctttccgtcgttcggtcccttacccgtaaaacgttccgtcgggacctaaaccgacccgggtaccccttacccctacggaccctactccgttccggtcggggtcccgtccggggccgttagggaacggggtaaccggaaggtcccttaactacttaagtttaccgcggactaacggtccttacaacttaactaacccaacgtanaaccgtactaaccttcgttggtcggttccggggcggacgggtacttacggaaacgttcggttaccccgttcgttacggcccgtaaacgccccggtaaacggtccgttacccgtcccccgttcggttaaccccg

SEQ ID NO: 418130 - DNA, 578 bp, Homo sapiens
  misc_feature: GZ8MTXP02FW4TP.9.1.A01.1.454.CMB.2.raw
  modified_base (339)..(339): a, c, t, g, unknown or other
  modified_base (376)..(376): a, c, t, g, unknown or other
  modified_base (456)..(456): a, c, t, g, unknown or other
tcagtgatacgtctcacgaccggtgctcgatttagacgtctcatcgaaggaaggaagggggggagaggagccccagccttgggattcccaagtgttttcattcagtgatcaggactgaacacagaggactcaccatggagtttgggctgagctggattttccttgctgctattttaaaaggtgtccagtgtgaggtgcaactggtggagtcgtgggggaggctcgggtcaagccgtggggagtcccttagactctcctgtgcaacctctggattcaatttcgacatcgcctggatgagttcggcccgcaggctcgagggaggctggagtgggtgacgtntaaagcaagggtgcggtggacagcagactacgcttcngtccgtaggaagggcagtattcgagtcatttccgagtaagacgatcgacaagacagatgtatgtattacgagtatagaanaacgaactaaaagtcggaagacaacacgaccttataactttcgtacgtccttcttacgtactttcggacgtaaggtcgggtacgtccggttaccgggtttacgggtccggtcgtttaccggg

SEQ ID NO: 418131 - DNA, 587 bp, Homo sapiens
  misc_feature: GZ8MTXP02HR1NO.9.1.A01.1.454.CMB.2.raw
  modified_base (398)..(398): a, c, t, g, unknown or other
tcagtgatacgtctcacgaccggtgctcgatttagacgtctcatcaaaggaaggaaggggggagaggagccccagccttgggattcccaagtgttttcattcagtgatcaggactgaacacagaggactcaccatggagtttgggctgagctggattttccttgctgctattttaaaaggtgtccagtgtgaggtgcaacgtggtggagtcgtgggggaggctcgggtcaaggccgtgggggactcccttagacttctcctgtgcaacctctgattcaatttcgacatcgcctggatggagttcggcccgcaggcctccgaggggaggggctggaggttggggtgacgttacgttaaaaggcgaaggggtagcgggtggaccagcagactacgcttangtccgtagaaggcagattcagctattccgagagacgatgacaagacagatgattgttactttagagtatagaacgagtaaccgtaaaagtcggaacaaccacgacaccttaattactttcgcgtcttacttctacgtttccgagtaaggtcggacgttcggttaccggtttcggtcgtttcggtaccgg

SEQ ID NO: 418132 - DNA, 752 bp, Homo sapiens
  misc_feature: GZ8MTXP02JVWJ2.9.1.A01.1.454.CMB.2.raw
  modified_base (251)..(251): a, c, t, g, unknown or other
  modified_base (256)..(256): a, c, t, g, unknown or other
  modified_base (268)..(268): a, c, t, g, unknown or other
  modified_base (273)..(273): a, c, t, g, unknown or other
  modified_base (289)..(289): a, c, t, g, unknown or other
tcagtgatacgtctcacgaccggtgctcgatttagacgtctcatcaagggaaggaagggggggagaggagccccagccttgggattcccaagtgttttcattcagtgatcaggactgaacacagaggactcaccatggagtttgggctgagctggtattttcctgctgctatttaaaggtgtccagtgtgagtgcaactggtggagtcgtgggggagctcggtcaagccgtgggatccttagctctctgtncactngatcattcgacntcgcnggatgagttcggcccncgaggcctcggagggaggggtctgggagtggggttaggacgtacgttaaaaggcgaaggggttagcggggtaggacccaggccaggtactaccgcttacgacgttcccgggtagggaaacggggtcaagggtactttacgacggtactaactttacccgaaggtacggaaccggaagttaggaaccgtaaaggaaccgaagggaacttaagggtaaactttggtttaaaactttaacgtaaagggaaccttaagggaaaccttaaaacggaaaaccccgtttaaaaaagtaccggggaaaacgtaaccaaccggtaaacgtaaccccctttaaacgtttaactttccgtaacggttaccccgttttacgttaccgttacgtttacggacggttaacggggttcgggttacggttcccggtttacccggggtttacggggttaccggtttaccgggttaccggg

SEQ ID NO: 418133 - DNA, 781 bp, Homo sapiens
  misc_feature: GZ8MTXP02GR1F3.9.1.A01.1.454.CMB.2.raw
  modified_base (236)..(236): a, c, t, g, unknown or other
tcagtgatacgtctcacgaccggtgctcgatttagacgtctcatcaagggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatcctcctgcactaggaactaacngtgacgttggtgtcttataattatgtctctgtatcaacacaccagaccaaacgcccccaatctattactttctgattcgtacaaactaacgtcccggacccccgtagggtactttacgtgactcgtcctttcctcgtcggcctaccgaacgttctcgggaccaaccgacccgtcccttcccctacgtaccctacttccgttccggtccgggggtcccgttcccgggggtcttacggggacgggaaccgggtacggtccgtaccgtaaaccgttacgtttacccgtacggtacctacggtaccttactaaaccttaaactaaccccgaaaaccgacggtaacccggtaaaccctaaccgtttacccgttggggttttacccgggttaccgggggtaccgggggtaaacggggttaaccgtacgggtaaacccgtttaccgggggtaacccccgtttacccggtaacgggtaaccccgtaccggaacccccggttaaccgggggtcccccttaccccgggtccccccggtttaacggtttccccccg

SEQ ID NO: 418134 - DNA, 567 bp, Homo sapiens
  misc_feature: GZ8MTXP01BI3T6.21.78.H01.1.454.CMB.2.raw
  modified_base (344)..(344): a, c, t, g, unknown or other
  modified_base (533)..(533): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccaggggaaggggcctgggagtgggatctcacttatttanagtggtggtaccccacatactacacaagactccgtgaagggccgattccaccatctcagaagacaattccaaggaacacattagtattcttacaaatgaataacctgtagagccgagacacggccatgtattactgtggtggggctatttcgtggaccccgttgggggcccgggttaaccctgggtccnccggtccctccccaccctcccgaaccgaaccggg

SEQ ID NO: 418135 - DNA, 566 bp, Homo sapiens
  misc_feature: GZ8MTXP01DAXD9.21.78.H01.1.454.CMB.2.raw
  modified_base (374)..(374): a, c, t, g, unknown or other
  modified_base (394)..(394): a, c, t, g, unknown or other
  modified_base (399)..(399): a, c, t, g, unknown or other
  modified_base (416)..(416): a, c, t, g, unknown or other
  modified_base (425)..(425): a, c, t, g, unknown or other
  modified_base (430)..(430): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttcttgttagctatttacaaaaggtgtccagtgtgaggtgcagttggtggagactgggaggaggcttgatccagccgtggggggtccctgagactctcctgtgcagtctctgggttcgtcagtggcgactacatgagctgggtccgcaggctccgagggaaggcctggagtggatctcactttattatagtggtgtacccacatactacacaagactcgngaaagggccatcacatctanagaanacatcaagaacatattntaatctaanaatanaagtaactagagacgacgacgacgacgacatatatactgtggtgggttgtacttacgttcgtacccggttacggggccgggacccggtcggtccgtaacccgtcccgtaccccacccctaacccgaacccgaaccg

SEQ ID NO: 418136 - DNA, 561 bp, Homo sapiens
  misc_feature: GZ8MTXP01EIHZP.21.78.H01.1.454.CMB.2.raw
  modified_base (357)..(357): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgaggggaagggcctggagtggatctcacttatttatagtggtggtaccccanatactacacaagactccgtagaagggccgattcacatctacagaagacaattccaggaaacacattgtatcttacaaatgaaataacctgaagagccgaggacacggaccatgtattactgtgtgggctatttacgttcgaccccgttgggggcccgggaacctcgggtccaacccgtcctccccaccctccgaaccgaaccgg

SEQ ID NO: 418137 - DNA, 574 bp, Homo sapiens
  misc_feature: GZ8MTXP01D8IZM.21.78.H01.1.454.CMB.2.raw
  modified_base (404)..(404): a, c, t, g, unknown or other
  modified_base (409)..(409): a, c, t, g, unknown or other
  modified_base (411)..(411): a, c, t, g, unknown or other
  modified_base (439)..(439): a, c, t, g, unknown or other
tcagtcgtcgctcgcacgaccggtgctcgattagtgtgagtagtttgggtttgggggggagaggagcccagcactgggattccgaggtgtttccattcggtgatcagcactgaacacagaggactcaccatggagttttggctgagcgtgggttttccgtgttagctattcaaaaggtgtccagtgtgaggtgcagttggtggagactggaggaggcttgatccagcctggggggtccctgagactctcctgtgcagtctctgggttctcagtggcgactacatgagctggggtcccgccaggctccgaggggaagggcctggagtggatctcactttatttataggtggtagtaccccatatactacacaagactccggtagaaagggcccattcaccatcanagaananatacagaacactatatatactataatanaataactagagagacgacgacgacgacatagtatacgtgtggtggttacgtacgttacgttacgtacccggttccggggccgggttaccggtccggtccgtcccgtccctccccacccctcccgaacccgaaccg

SEQ ID NO: 418138 - DNA, 579 bp, Homo sapiens
  misc_feature: GZ8MTXP01BTMCX.21.78.H01.1.454.CMB.2.raw
  modified_base (361)..(361): a, c, t, g, unknown or other
  modified_base (453)..(453): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggtaggcttgatccagccgtggggggtccctgagactctcctgtgcagtctctgggttcgtcagtggcgactacatgagctgggtcccgccaggctccgaggggaagggcctggagtggatctcacttatttatagtggtggtaccccanatactacacaagactccgtagaaagggccgattcaccatctcagaagacaattccaaggaaacacattgatcttacaaatgaaataactganagcgagcaggccatgtatactgtgtggggctagtttacgttcgacccccgttggggggccccggggaacccctggggtccctaacccggtcctaccccccgaccctccccgaacccgaacccgggg

SEQ ID NO: 418139 - DNA, 561 bp, Homo sapiens
  misc_feature: GZ8MTXP01ASG8W.21.78.H01.1.454.CMB.2.raw
  modified_base (402)..(402): a, c, t, g, unknown or other
  modified_base (538)..(538): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgagggagggcctggagtggatctctactttatttatagtggtcggtaccccactatactacacaagactcgtagacgggccgattccacatctanaagaagacaacttccgaaggaaaccactattgtactctacaaatgaaatactgagacgaccgagacacggcatgtatacgtgtgtgggctagtttcgtacgtccccgttgggggcccggaccgtggcctcccgtcnccccaccctccgaaccgaaccgg

SEQ ID NO: 418140 - DNA, 557 bp, Homo sapiens
  misc_feature: GZ8MTXP01AQS55.21.78.H01.1.454.CMB.2.raw
  modified_base (531)..(531): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctgggagtgggatctcacttatttatagtggtggtaccccacatactacacaagactccgtgaagggccgattcaccatctcagaagacaattccaggaacacattgtatcttacaaatgaaataacctgagagccgagacacggccatgtattactgtgtggggctatttacgtcgaaccccttgggggcccgggaaccctgggcaacccggtcncccccaccctccgaacccgaaccggg

SEQ ID NO: 418141 - DNA, 546 bp, Homo sapiens
  misc_feature: GZ8MTXP01EL2E3.21.78.H01.1.454.CMB.2.raw
  modified_base (413)..(413): a, c, t, g, unknown or other
  modified_base (438)..(438): a, c, t, g, unknown or other
  modified_base (477)..(477): a, c, t, g, unknown or other
  modified_base (526)..(526): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgaggggaagggcctgggagtggatcgtctactttatttatagtggtacggtaccccactatactacacaagactccgtgaaagggccattccacatctcagaanacaatccagaacactatgtatctanaaatgaactaactgagacgcgagacacggcatgtatacngtgtgggctagtttcgtcgacccgttgggggccggacctgcaaccgtcncccacctccaaccgaaccgg

SEQ ID NO: 418142 - DNA, 578 bp, Homo sapiens
  misc_feature: GZ8MTXP01C8TN9.21.78.H01.1.454.CMB.2.raw
  modified_base (395)..(395): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaaggggcctgggagtgggatctcacttatttatagtggtggtaccccacatactacacaagactccgtgaagggccgatcacanctcagaagacaattccaaggaacacattgtatcttacaaatgaaataacctgaagagaccgaggacacggccagtgtatactgtggtggggctagtttacgttcgaccccgttggggggcccggggaaccctggggtacccaaccggtccctcccccacccgtcccgaacccgtaacccgggg

SEQ ID NO: 418143 - DNA, 560 bp, Homo sapiens
  misc_feature: GZ8MTXP01D0JZE.21.78.H01.1.454.CMB.2.raw
  modified_base (404)..(404): a, c, t, g, unknown or other
  modified_base (412)..(412): a, c, t, g, unknown or other
  modified_base (441)..(441): a, c, t, g, unknown or other
  modified_base (474)..(474): a, c, t, g, unknown or other
  modified_base (480)..(480): a, c, t, g, unknown or other
  modified_base (528)..(528): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtcccgccaggctccgaggggaagggcctaggagtggatctctactttatttataggtggtacggtaaccccacatactacacaagactccggtgaaacggggccattcacntactcaanaagacaattccagaaacacattgatctanaaatgaataactgagacgcgaggacacggcatntatacngtgtgggctatttacgtcgcccgttggggcccggggaccctgggtccnccgtccgtccccacctcccgaacgaacccggg

SEQ ID NO: 418144 - DNA, 559 bp, Homo sapiens
  misc_feature: GZ8MTXP01DLXM9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaagggcctggagtggatctcactttatttatagtggtgtacccacatactacacaagactcgtgaacgggccattcacatctcaagaagacaattccaaggaaacactattgtatcttacaaatgaaataaacctgaagagccgaggacacggccatgtatactgtgtggggctatttacgtcgaccccgttgggggcccgggaaccctgggtccaaccggtcctccccaccctccgaaccgaaccggg

SEQ ID NO: 418145 - DNA, 591 bp, Homo sapiens
  misc_feature: GZ8MTXP01AC1B0.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgcaggctccgagggaagggcctggagtggatctcacttatttatagtggtgtacccacatactacacaagactcgtgaagggccgattcacatctacagaagacaattccaaggaacactattgtatctacaaatgaataacctgagagaccgagacacggccagtgtattacgtgtaaggtggggacttagtttacgttcggaaccccggttcgggggccccggggttaaacccgttggggtcccctaaccgggtcccctcccccgacccttcccgaacccggaacccgggg

SEQ ID NO: 418146 - DNA, 557 bp, Homo sapiens
  misc_feature: GZ8MTXP01BHF7Y.21.78.H01.1.454.CMB.2.raw
  modified_base (534)..(534): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaaggggcctgggagtgggatctcacttatttatagtggtggtaccccacatactacacaagactccgtgaaaggggccattcacatctcagaagacaattccaaggaacacattgtatcttacaaatgaataacctgaagagccgaggacacggccatcgtattactgtgtgggggctatttacgtgaccccttgggggcccgggacctggtcaaccgtcnccccacctccgaaccgaaccggg

SEQ ID NO: 418147 - DNA, 566 bp, Homo sapiens
  misc_feature: GZ8MTXP01EE5M6.21.78.H01.1.454.CMB.2.raw
  modified_base (363)..(363): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccaggcctaccgaggggaagggcctggagtggatctctacttatttatagtggtgtaccccanatactacacaagactccgtgaacgggccatcacatctacagaagacatccaagaacactattgtatctacaaatgaactaactgaagagccgagacacggacatgtattacgtgtggtgggctatttcgtcggacccgttgggggcccggttaaccgtgggtccaacccgtccctaccccgaccctcccgaaccgaacccggg

SEQ ID NO: 418148 - DNA, 565 bp, Homo sapiens
  misc_feature: GZ8MTXP01BC30W.21.78.H01.1.454.CMB.2.raw
  modified_base (454)..(454): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcaggtggcgactacatgagctgggtccgccaggctccgagggagggcctgggagtggatctctacttatttataggtggtggtaccccacatactacacaagactccgtgaacgggccattccaccatctacagaagacaattccaaggaacactattgtatcttacaaatgaataacctganacgaccgagacacggcctatcgtatactgtggtgggctattcgtcgcccggttggggcccgggttaccctggtcccaaccgtccctccccaccctccgaaccgtaacccgg

SEQ ID NO: 418149 - DNA, 539 bp, Homo sapiens
  misc_feature: GZ8MTXP01CK9MQ.21.78.H01.1.454.CMB.2.raw
  modified_base (297)..(297): a, c, t, g, unknown or other
  modified_base (344)..(344): a, c, t, g, unknown or other
  modified_base (449)..(449): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtcccnccaggctccgaggggaagggcctgggagtgggatctcacttatttanagtggtggtaccccacatactacacaagactccgtgaaagggccgatcaccatctacagaagacaattccaggaacacattgtatcttacaaatgaataactganagccgagacacggccatgtatacgtgtgtggggctattcgtgacccgttggggccggacctggcaaccgtctcccacctcaacgtaacgg

SEQ ID NO: 418150 - DNA, 597 bp, Homo sapiens
  misc_feature: GZ8MTXP01D9YMT.21.78.H01.1.454.CMB.2.raw
  modified_base (340)..(340): a, c, t, g, unknown or other
  modified_base (355)..(355): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagctgggtcccgccaggctccgagggaggcctggagtggatctcacttatttanagtggtgtaccccanatactacacaagactcggtagaaacgggccattcacatctacagaagacaattccaaggaaacactattgattcttaacaaatgaaataacctgaagacgccgaaggacacggaccatgtattacgtgtaaggtggggctagttttacgtccggtaaccccggttcgggggcccggggttaaccccgtcggtacccgtaacccggtccctcccccaccccgtccccgaacccgaaccccggg

SEQ ID NO: 418151 - DNA, 579 bp, Homo sapiens
  misc_feature: GZ8MTXP01BPPBO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtcccgccaggctccgagggaagggcctggagtggatctctacttatttatagtggtggtaccccacatactacacaagactcgtgaagggccattcacatctacagaagacaaattccaaggaacactattgtatcttacaaatgaaataacctgaagagccgagacacggccagtgtattacgtgtaaggtggggctagtttaccgtcgtaccccggttgggggcccggggttaccctgggtcccaaccggtccctccccgaccctcccgaaccgaacccggg

SEQ ID NO: 418152 - DNA, 568 bp, Homo sapiens
  misc_feature: GZ8MTXP01A0QKB.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgcaggctccgagggagggcctggagtggatcgtcactttatttatagtggtcggtaccccacatactacacaagacctccgtgaagggccgattcaccatctacagaagacaattcccaggtaaacactaattgtatcttacaaatagaataacctagagacgacgaggacacggcatcgtatactgtgtggggctagtttacgtcgacccgttgggggcccgggaccctggtcccaaccggtcctccccacctcccgaaccgaacccgg

SEQ ID NO: 418153 - DNA, 582 bp, Homo sapiens
  misc_feature: GZ8MTXP01CYKUV.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaaggggcctgggagtgggatctcactttatttatagtggtggtaccccacgatactacacaagactccgtgaagggccgattcacatctcagaagacaattccaaggaacacattgatcttacaaatgaataacctgagacgccgaaggaccacggccagtcgtaattcctggtcgttggggcttaatttcgttcggaaccccgttgggggcccggggaacccttgggtcccaaccggtcctaccccgaccctcccgaaccgtaacccgggg

SEQ ID NO: 418154 - DNA, 614 bp, Homo sapiens
  misc_feature: GZ8MTXP01D9Y2J.21.78.H01.1.454.CMB.2.raw
  modified_base (271)..(271): a, c, t, g, unknown or other
  modified_base (362)..(362): a, c, t, g, unknown or other
  modified_base (446)..(446): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagccgtggggggtccctgagactctcctgtgcagtctctgggttcncagtggcgactacatgagcgtgggtccgccaggctccgagggaggggcctgggagtggatctctactttatttatagtggtcgtaccccanatactacacaagactccggtgaaacggggccattcaccatctcagaaagacaattccgaaggaaaccatattagtatcttaaanaaagtagaaacgtaacgtagaacgacgaccgaagactacggactagtagtattacgtggtggtgggttacttacgtttaccgtccggtaccccgggttcgggggccccgggttaccgtcggtacccgtcccgtcccctaccccacccgtaacccgaacccgtaaccgg

SEQ ID NO: 418155 - DNA, 577 bp, Homo sapiens
  misc_feature: GZ8MTXP01ADEFE.21.78.H01.1.454.CMB.2.raw
  modified_base (358)..(358): a, c, t, g, unknown or other
  modified_base (402)..(402): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggaaggcctggagtggatctcactttattatagtggtggtacccanatactacacaagactccgtgaacgggccattcacatctcagaanacaatccagaacacattgtatcttacaaatgaaataacctgagacgcgagacacggccatgtattactgtgtggggctatttacgtacgtaccccggttgggggcccggggttaacccgtcgggtccaaccccggttccctacccccgaccccgtcccgaacccgtaacccgggg

SEQ ID NO: 418156 - DNA, 600 bp, Homo sapiens
  misc_feature: GZ8MTXP01DZ4GR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaagggcctggagtggatctctactttatttatagtggtcgtaccccactatactacacaagactccggtgaaagggccgattcaccatctacagaagacaacttccaaggaacactattgtatacttacaaaatgaaataacctggaagacgccgaaggacacggaccatgtattacgtgtggtggggctacgtttcgtacggaccccgttcggggggcccggggaacccttcgggtaccaaccccggttccctcccccacccgttccccgaaccgtaaccccgggg

SEQ ID NO: 418157 - DNA, 536 bp, Homo sapiens
  misc_feature: GZ8MTXP01BF1AI.21.78.H01.1.454.CMB.2.raw
  modified_base (340)..(340): a, c, t, g, unknown or other
  modified_base (390)..(390): a, c, t, g, unknown or other
  modified_base (397)..(397): a, c, t, g, unknown or other
  modified_base (399)..(399): a, c, t, g, unknown or other
  modified_base (414)..(414): a, c, t, g, unknown or other
  modified_base (420)..(420): a, c, t, g, unknown or other
  modified_base (454)..(454): a, c, t, g, unknown or other
  modified_base (468)..(468): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccagggaagggcctggagtggatctcacttatttanagtgtgtacccacatactacacaagactcgtgaaagggccattcacatcncagaaananatcaagaacatatanatctanaaatagaaataactgagacgacgagacacgcatntatatgtggtgggntattacgtcgcccggttcggggccgggaccgtggtccaaccgtccctccccaccctccgaaccgaacg

SEQ ID NO: 418158 - DNA, 596 bp, Homo sapiens
  misc_feature: GZ8MTXP01AGOMK.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctctacttatttatagtggtggtaccccacatactacacaagactccgtgaacgggccgattcacatctcagagacaattccaggaacactattgtatcttacaaatagaactaactgagacgaccgaggacgacggaccagtcgtaattacgtgtgtggggctagtttacgttcggacccccggttgggggccccggggaaccccgtcgggtcctaacccgggtcccctacccccgaccccttccccgaaccggtaaaccccgggg

SEQ ID NO: 418159 - DNA, 547 bp, Homo sapiens
  misc_feature: GZ8MTXP01AWZGI.21.78.H01.1.454.CMB.2.raw
  modified_base (296)..(296): a, c, t, g, unknown or other
  modified_base (337)..(337): a, c, t, g, unknown or other
  modified_base (351)..(351): a, c, t, g, unknown or other
  modified_base (470)..(470): a, c, t, g, unknown or other
  modified_base (513)..(513): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccncaggctccgagggagggcctggagtggatctcacttattanagtggtgtacccanatactacacaagactcgtgaaagggccgattcaccatctcagaagacaattccaggaaacactattgtatcttacaaactgaaataacctgagacgcgagacacggccatgtattacgngtgtgggctattacgtcgaccccgttgggggcccgggttaccnggtccaacgtcccgtcccacctccaacgaaccgg

SEQ ID NO: 418160 - DNA, 558 bp, Homo sapiens
  misc_feature: GZ8MTXP01AXHS9.21.78.H01.1.454.CMB.2.raw
  modified_base (298)..(298): a, c, t, g, unknown or other
  modified_base (488)..(488): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtccnccaggctccgaggggaagggcctggagtgggatctcacttatttatagtggtggtaccccacatactacacaagactccgtgaaagggccattcaccatctcagaagacaattccaggaaacacattgtatcttacaaaattgaaataacctgagagccgagacacggtccatgtatactgaagtggggnagtttactgaccccgttggggccgggaacccgtgggcaaccggtcctccccacctcccgaaccgaaccgg

SEQ ID NO: 418161 - DNA, 557 bp, Homo sapiens
  misc_feature: GZ8MTXP01B7VON.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccaggctccgaggggagggcctggagtggatctcactttatttatagtggtgtaccccacatactacacaagactccgtgaacgggccgattcaccatctacagaagacaattccaaggaacacattgatcttacaaatgaataactagagacgccgagacacggccatgtatactgtgtgggctatttcgtcgacccgttcgggggcccgggacctggcccaaccgtccctccccaccctcccgaaccgtaaccgg

SEQ ID NO: 418162 - DNA, 586 bp, Homo sapiens
  misc_feature: GZ8MTXP01AX9KY.21.78.H01.1.454.CMB.2.raw
  modified_base (555)..(555): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgaggggaagggcctgggagtggatctcgtacttatttatagtggtgtaccccacatactacacaagactccgtagaagggccgattcaccatctcagaagacaattccagtaacacattgtatctacaaatgaataactgaagacgcgagacacggaccatcgtattactggtaagtggggactacgtttaccgttcggaccccgttgggggccccggggttaaccccgtgggtccgaacccggttcccncccccgaccccttccgaacccgtaacccggg

SEQ ID NO: 418163 - DNA, 558 bp, Homo sapiens
  misc_feature: GZ8MTXP01BFN7D.21.78.H01.1.454.CMB.2.raw
  modified_base (534)..(534): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatggagcgtggggtcccgccaggctccgaggggaaggggcctgggagtggatctcactttatttatagtggtcggtaccccacatactacacaagactccgtgaacgggccattcacatctcagagacaatccagaacacattgatctacaaatgaaataacctgagagccgaagacacgcatgtatactgtgtgggctacgtttcgtcgacccgttcgggggcccgggaccctgggcccaaccgtcccnccccaccctcccaacgtaacccgg

SEQ ID NO: 418164 - DNA, 582 bp, Homo sapiens
  misc_feature: GZ8MTXP01CO15A.21.78.H01.1.454.CMB.2.raw
  modified_base (442)..(442): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggctccgagggaacgggcctggagtggatcgtcacttattatagtggtcgtaccccatatactaacacaagactccgtagaacgggccattcacatctacaagaacgacaattccaaggaacacgtattgtatccttaaanaaatagaactaacgtagaacgacgacgagaccacgacagtagtacttgtggtggtggacttacttccgtccggcccggttcgggggcccgttaccgtcggccctaacccgtcccaccccaccctaaccgaaccgtaaccg

SEQ ID NO: 418165 - DNA, 665 bp, Homo sapiens
  misc_feature: GZ8MTXP01B4T1T.21.78.H01.1.454.CMB.2.raw
  modified_base (364)..(364): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtcagtgtgaggtgcagttggtggagacgtggaggaggcttgatccgagccgtgggggtccctgagactctcctgtgcagtctcgtgggttcgtcaggtggcgaactacatggagcgtgggtcccgcgaggctccgaaggggaagggcctggagtggatcgtcactttattatagtggtgtacccanatactacacaagactcgtaggaagggccgaattccaacctatctacaagaacgaactaaatccgaaggaaacactaattgtaatcttaacaaattacgaaattaaaccgtaggaacggacgaacccggaaggaaccgacggacctattaggttaacttacgtggttgggtcggggttacttaagtttaccgttccggaaccccggttggggggaccccggggttaaacccgttcggggtacccgtaacccccgtttacccgtccccccgaaccccttccccgaaccccggtaaaccccggg

SEQ ID NO: 418166 - DNA, 562 bp, Homo sapiens
  misc_feature: GZ8MTXP01D69FA.21.78.H01.1.454.CMB.2.raw
  modified_base (356)..(356): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctcacttatttatagtggtggtaccccanatactacacaagactccgtgaagggccgattcacatctcagaagacaattccaggaacacattgatcttacaaatgaaataacctgaagagccgaggacacgggaccatgtattactgtgtggggctagtttactcggaccccgttgggggcccgggttaacccgtgggtccaaccgtcctccccaccctcccgaaccgaaccggg

SEQ ID NO: 418167 - DNA, 573 bp, Homo sapiens
  misc_feature: GZ8MTXP01BJOSX.21.78.H01.1.454.CMB.2.raw
  modified_base (358)..(358): a, c, t, g, unknown or other
  modified_base (481)..(481): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctggggttcgtcagtggcgactacatgagctgggtcccgccaggctccgaggggaaggcctgggagtgggatctcacttatttatagtggtgtaccccanatactacacaagactccgtgaaacgggccattcaccatctcagaagacaattccaaggaacactattgtatcttacaaatgaaataacctgaacgagaccgaggacacggaccatgtattacnggtaagtggggctagtttacgtcgtaccccgttgggggcccgggaaccctgggtccaaccggtcctccccaccctccgaaccgtaacccggg

SEQ ID NO: 418168 - DNA, 562 bp, Homo sapiens
  misc_feature: GZ8MTXP01D5TP4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaagggcctggagtggatctcacttatttatagtggtgtaccccacatactacacaagactcgtgaagggccattcacatctcagaagacaattccaaggaaacactaattgtaatcttacaaaatgaaataaacctgaagagccgaaggacacggccatgtattactgtgtggggctatttacgttcggaccccttgggggccgggaaccctgggtccaaccggtcctccccgacctccgaaccgaaccggg

SEQ ID NO: 418169 - DNA, 577 bp, Homo sapiens
  misc_feature: GZ8MTXP01DEBP7.21.78.H01.1.454.CMB.2.raw
  modified_base (361)..(361): a, c, t, g, unknown or other
  modified_base (402)..(402): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgcaggctccgaggggaagggcctggagtggatctcactttattatagtggtcgtaaccccanatactacacaagactccgtagaaacgggccattcacatcanagaagacaatccaagaacactatgtatcttacaaatgaaataactgaagacgccgaagacacggaccagtgtaattactggtaaggtggggactatttacgtcgaccccggttgggggcccgggaacccgtgggacctaacccggtcctaccccaccctcccgaaccgaaccggg

SEQ ID NO: 418170 - DNA, 559 bp, Homo sapiens
  misc_feature: GZ8MTXP01BPE4I.21.78.H01.1.454.CMB.2.raw
  modified_base (355)..(355): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggagggcctggagtggatctcacttattatagtggtgtaccccanatactacacaagactccgtgaacgggccattcacatctcagaagacaatccagaacacattgtatcttacaaatgaataactgagagccgagacacggcatgtattactgtgtggggctagtttacgtcggtaccccgttgggggcccgggaacccgtcgggtccaacccgttcctcccccaccctcccgaacccgaacccggg

SEQ ID NO: 418171 - DNA, 563 bp, Homo sapiens
  misc_feature: GZ8MTXP01ED85F.21.78.H01.1.454.CMB.2.raw
  modified_base (458)..(458): a, c, t, g, unknown or other
  modified_base (484)..(484): a, c, t, g, unknown or other
  modified_base (492)..(492): a, c, t, g, unknown or other
  modified_base (538)..(538): a, c, t, g, unknown or other
tcagtcgtcgctcgcacgaccggtgctcgattagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtcccgcaggctccgagggaagggcctggagtggatctcacttatttatagtggtcggtaccccacatactacacaagactccggtgaacgggccgattcaccatctacaagaacgacaacttccaaggaacactattgtatcttacaaatgaaataactgaanacgccgagacgacgccatgtattacngtgtgggntatttacgtcgcccgttgggggccgggaccgtcggtcaaccgtccnccccacctcccgaaccgtaacccgg

SEQ ID NO: 418172 - DNA, 597 bp, Homo sapiens
  misc_feature: GZ8MTXP01B1WV6.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgttagtggcgactacatgagctggggtccgccaggctccgaggggaagggcctgggagtggatctcactttatttatagtggtggtaccacatactacacagaacctccgtgaaacgggcccgattcaccatctacagaagacaattccaaggaacaacattgtatcttacaaatagaataaccgtgaagagaccgaggacacggccatgtatactgtgtggggcttagtttacgttcgtaccccgtcgggggcccggggacccgttcggtcccgtaccccggtccctcccccgaccccttccccgaacccgttaaccggggaacccc

SEQ ID NO: 418173 - DNA, 695 bp, Homo sapiens
  misc_feature: GZ8MTXP01CTYVL.21.78.H01.1.454.CMB.2.raw
  modified_base (361)..(361): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgagcgtcgggtccgccaggcctccgagggaagggcctggagtggatctcacttattatagtggtgtaccccanatactacacaagacctccgtaggaaacgggtacccaacgttaaaccattctacgaaagtaaacgaactaaacttaccgaaggaaaccaactatttagtaacttacttacaaaatagaaacttaaccgtagaagaacgaccgaacggacaaccggaccaagttagtaatttaacgtggttgggtgggggtacttaacgttttaccgttccgggtaacccccgggtcggggggttaccccggggttaaaccccgttccggggttcccgtaacccccggttcccctacccccccgtaccccgttaccccgaaaccccggaaccggggtaaccccccg

SEQ ID NO: 418174 - DNA, 785 bp, Homo sapiens
  misc_feature: GZ8MTXP01C132J.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcgaggtggcgactacatgagcgtcgggtccgccgacggctaccggaggggaacggggccgtaggaggtggacttctactaactttatttaagtaggttggtacggtaacccccagtactaacctaacacaaacgaccttccggtaggaaacggggcctaacttccaacctagtcctacgaaagaaacgaactaaacttacccgaaaggtaaacctaacttaatttacggtaacttacccgttaaactaaaagttacggtaaaactttaaaccccggttaggaaacgggaaccggacccgggaaacgggaacccgaacccggggtaaccctaaggttacgttaaacgttaccgttgggtaagggttacgggggttaccttaacgtttttaccggtccggtaacccccggggttcggggggaccccgggttaaaccccggtttcggggtaacccctccccgggttcccctaccccccgttaaccccgttccccgaaaccccgggtaaccccggg

SEQ ID NO: 418175 - DNA, 559 bp, Homo sapiens
  misc_feature: GZ8MTXP01DP6VZ.21.78.H01.1.454.CMB.2.raw
  modified_base (364)..(364): a, c, t, g, unknown or other
  modified_base (531)..(531): a, c, t, g, unknown or other
  modified_base (542)..(542): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtcccgcgaggcctccgaggggaagggcctggagtggatctctactttatttatagtggtggtacccanatactacacaagactccggagaagggccgattccgaccatctacagaagacaattccaaggaacacattgaatctacaaatgaaactaactgagacgaccgagacacgaccatgtatctgtgtgggctagtttacgtggaccccgttggggccgggaccctggtacnccgtctccccncctcccaacgaacccgg

SEQ ID NO: 418176 - DNA, 603 bp, Homo sapiens
  misc_feature: GZ8MTXP01A9EI6.21.78.H01.1.454.CMB.2.raw
  modified_base (414)..(414): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccgtgggggtccctgagactctcctgtccagtctctgggttcgtcagtggcgactacatgagctgggtccgcgaggctccgaggggaaggcctggagtggatcgtctactttatttagtagtggtacggtaccactatactacacagaacctccggtgaaacgggccattcaccatctacagtaanacaattccgaagaacaactattgtatacttacaaatcgaaataaccgtgagacgaccgagacacggactaatgtaattacgtggtggtggggcttattttaccgttcggaaccccgttgggggaccccgggttaaccgttcggccctacccgtcctccccccaccttacccgaacccgaacgggtcccc

SEQ ID NO: 418177 - DNA, 658 bp, Homo sapiens
  misc_feature: GZ8MTXP01DLFKM.21.78.H01.1.454.CMB.2.raw
  modified_base (301)..(301): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtccncaggctccgagggaggcctggagtggatcgtctaactttatttataggtggtacggtaaccccacgtataacgtacaacgaacgactcccggtaggaaacggggcccgtaattccgaaccatcctacaagaaagaacaaacttccaaaggaaactactaattacgtaatacttaacaaatagaaacttaacgtagaagagaccgaagaccgaacggaccagtagttaacttacgtggttggtggggttctagttttaccgtccggtaccccggttcgggggccccgggttaaacccgttcgggtacccctaacccggtcccctacccccaccccgtcccgaaccccgaaccccgggg

SEQ ID NO: 418178 - DNA, 633 bp, Homo sapiens
  misc_feature: GZ8MTXP01CSQ4E.21.78.H01.1.454.CMB.2.raw
  modified_base (367)..(367): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtcccgcgaggctccgaggggaagggccgtaggagtggatctctactttatttatagtggtcgtacccanatactacacaagactccgagaacgggccgattcactatcacaagaacgactaattccgaaggaactacgtattacgtacttcttaacaaatacgaaattaacccgtagaacgacgaccggaaggaaccgacggtacctagttacgttattaccgtggtcgggtgggacttacgtttacgtccggaccccgggttcgggggcccgggttaaacccgtgggtcccaaccgttccccgaccccacccgtaacccgaaccggtaacccgg

SEQ ID NO: 418179 - DNA, 544 bp, Homo sapiens
  misc_feature: GZ8MTXP01EFIOA.21.78.H01.1.454.CMB.2.raw
  modified_base (343)..(343): a, c, t, g, unknown or other
  modified_base (358)..(358): a, c, t, g, unknown or other
  modified_base (427)..(427): a, c, t, g, unknown or other
  modified_base (466)..(466): a, c, t, g, unknown or other
  modified_base (521)..(521): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtcccgccaggctccgagggagggcctggagtggatctctacttatttanagtggtgtaccccanatactacacaagactcgtgaagggccattcacatctcagaagacaattccaagaacactatgtatctanaaatgaaatactgagagccgagacacggacatgtattcngtgtgggctatttacgtcgacccgttgggggccgggacctgggtccaacgtcccnccccgacctccgaaccgaaccgg

SEQ ID NO: 418180 - DNA, 565 bp, Homo sapiens
  misc_feature: GZ8MTXP01DKT7N.21.78.H01.1.454.CMB.2.raw
  modified_base (359)..(359): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagctgggtccgcaggctccgagggaagggcctggagtggatctcactttatttatagtggtggtaccccanatactacacaagactccgtgaagggcccccattccacatctcagaagacaattccaaggaacacattgtatcttacaaatgaaatacctgagagccgagacacggcatgtatactgtgtgggctagtttacgtcggccccgttgggggcccggggaaccctgggtacccaaccgtccctccccacccctccgaaccgtaacccggg

SEQ ID NO: 418181 - DNA, 565 bp, Homo sapiens
  misc_feature: GZ8MTXP01EPK4C.21.78.H01.1.454.CMB.2.raw
  modified_base (297)..(297): a, c, t, g, unknown or other
  modified_base (430)..(430): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctctgtgcagtctcgtgggttcgtcagtggcgactacatgagctggggtccnccaggctccgagggaagggcctggagtggatctcacttatttatagtggtgtacccacatactacacaagactcgtgaaagggccgattcaccatctcagaagacaattccaaggaaacacattgtaatctanaaatgaataaacctgagagccgagacacggaccatgtattactgtgtggggctatttacgtcggtaccccgttgggggcccgggaacccgtggtcctaaccggtcctccccaccctcccgaaccgtaaacccggg

SEQ ID NO: 418182 - DNA, 591 bp, Homo sapiens
  misc_feature: GZ8MTXP01C1WCC.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtcccgcaggctccgaggggaagggcctggagtggatctcactttatttatagtggtcggtaccccacatactacacaagactccgtgaacgggccgatcaccatctacagaagacaattccaaggaacacattgtatcttacaaatgaaataaacctgaagagccgagacacggccatgtattacgtggtaaggtggggctagtttacgttcggaccccgttagggggcccggggttaaaccctgggtacccgaacccgtccctacccccgaccccttcccgaacccgtaacccgggg

SEQ ID NO: 418183 - DNA, 614 bp, Homo sapiens
  misc_feature: GZ8MTXP01BWVAD.21.78.H01.1.454.CMB.2.raw
  modified_base (360)..(360): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttctcagtggcgactacatgagcgtgggtccgccaggctccgaggggagggcctggagtggatctctactttattatagtggtggtaccccanatactacacaagacctccggtagaacgggcccgattcaccatctacaagaacgacaattccaaggaacactattgtatcttacaaatagaataacctagagacgacgagaccacggaccatgtatcgtggtggtggggttctacgtttacgtccggtaccccggttcggggggccccggggttaaccccgttgggtacccctaaccccggttcccctaccccccgacccctaaccccgaacccgaaccccgggg

SEQ ID NO: 418184 - DNA, 581 bp, Homo sapiens
  misc_feature: GZ8MTXP01D12IZ.21.78.H01.1.454.CMB.2.raw
  modified_base (557)..(557): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggaagggcctgggagtggatctcactttatttatagtggtcgtaccccacatactacacaagactccgtgaacggggccattcaccatctcagaagacaattccaaggaaacactattgtatcttacaaatgaaactaaacctgaagacgaccgaaggacacggaccatgtattactggtaagtggggctagtttacgtcggtaccccggttgggggcccgggaaccgtgggtccaaccgtcccnccccacctcccgaaccgaaccggg

SEQ ID NO: 418185 - DNA, 667 bp, Homo sapiens
  misc_feature: GZ8MTXP01DW42T.21.78.H01.1.454.CMB.2.raw
  modified_base (359)..(359): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagcgtgggtccgcaggctccgagggaggcctggagtggatctctactttattatagtggtcgtacccanatactacacaagactccggtgaacgggcccattccatactactctacgaagaacgaactaacgttaccgaaaggtaactaacgtattatacttaaccttaataaagtaggtaaactaacgtagaacgacgaccggaagaccgaacgtactagttagttaacttcgtaaggtgggttacggggtactttacgttttaccggtacccgggttaccccggggttcggggggttaacccccggggtaacccgtccgggtaacccgtaccccggtccccttaccccctaaccccgttaacccgaaaccccggg

SEQ ID NO: 418186 - DNA, 816 bp, Homo sapiens
  misc_feature: GZ8MTXP01A4YIX.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccggtcgggggtcctgagactctcctgtgcagtctcgtgggttcgtcgaggtggcgactacagtgagcgtcgggtcccgccgaggcctaccggaaggggaacgggtccgtaggggaggtgggtactccgtactaacttttatttagtaggttgggtacggtaaccccactaatacctacaacgaacgtacctcccggtagggaaaccggggtcctacttaccgaacctactaccctacgaaaggtaaacgaacctaaacgttaccccggaaagggtaaaccctaagttatttacggtaaactttacccttaaactaaaaaagttacggaaaaactttaaaccccggtggggaaacggaaccgggtacccgggaaagggaaccccgaccggggtaaccctaaaggtttgtttaaacttaccggttgggttaagggggtccggggttactttaaacgtttttaccgtaccccggggtaacccccgggggttcggggggacccccgggttaacccgttgggggtaccccctaacccgggtttcccccaccccccgttaaccccttcccggaaaacccgggtaacccccggggg

SEQ ID NO: 418187 - DNA, 587 bp, Homo sapiens
  misc_feature: GZ8MTXP01C8MYG.21.78.H01.1.454.CMB.2.raw
  modified_base (301)..(301): a, c, t, g, unknown or other
  modified_base (359)..(359): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccncaggctccgagggaagggcctggagtggatctcactttattatagtggtggtacccanatactacacaagactccgtgaaagggccgatccaccatctacagaagacaattccaaggaaacactattgtatcttacaaatgaaataacctgaagagcgagacacggccatgtatactgtgtggggctagttacgttcggaccccgttcgggggcccggggttaaccccgtcgggtaccctaacccggtccctacccccgacccctcccgaacccggtaaacccggg

SEQ ID NO: 418188 - DNA, 558 bp, Homo sapiens
  misc_feature: GZ8MTXP01BQW47.21.78.H01.1.454.CMB.2.raw
  modified_base (482)..(482): a, c, t, g, unknown or other
  modified_base (526)..(526): a, c, t, g, unknown or other
  modified_base (534)..(534): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgagcgtcgggtccgcgaggctccgagggaggcctggagtggatctctactttattatagtggtcgtacccacatactacacaagactcgagaacgggccatcacatctacagaagacaatccaagaacactattgatctacaaatagaactaactgagacgcgagacacggctatgtattacgtggtggtgggntattacgtcggaccccgttgggggcccgggttaccgtcggtccncccgtccnccccacctcccgaaccgtaaccgg

SEQ ID NO: 418189 - DNA, 445 bp, Homo sapiens
  misc_feature: GZ8MTXP01E3343.21.78.H01.1.454.CMB.2.raw
  modified_base (258)..(264): a, c, t, g, unknown or other
  modified_base (271)..(271): a, c, t, g, unknown or other
  modified_base (304)..(306): a, c, t, g, unknown or other
  modified_base (308)..(308): a, c, t, g, unknown or other
  modified_base (310)..(310): a, c, t, g, unknown or other
  modified_base (320)..(320): a, c, t, g, unknown or other
  modified_base (326)..(326): a, c, t, g, unknown or other
  modified_base (330)..(330): a, c, t, g, unknown or other
  modified_base (334)..(334): a, c, t, g, unknown or other
  modified_base (337)..(337): a, c, t, g, unknown or other
  modified_base (341)..(341): a, c, t, g, unknown or other
  modified_base (345)..(345): a, c, t, g, unknown or other
  modified_base (347)..(347): a, c, t, g, unknown or other
  modified_base (349)..(351): a, c, t, g, unknown or other
  modified_base (353)..(353): a, c, t, g, unknown or other
  modified_base (357)..(357): a, c, t, g, unknown or other
  modified_base (361)..(361): a, c, t, g, unknown or other
  modified_base (367)..(367): a, c, t, g, unknown or other
  modified_base (395)..(395): a, c, t, g, unknown or other
  modified_base (397)..(397): a, c, t, g, unknown or other
  modified_base (399)..(399): a, c, t, g, unknown or other
  modified_base (401)..(401): a, c, t, g, unknown or other
  modified_base (403)..(403): a, c, t, g, unknown or other
  modified_base (409)..(409): a, c, t, g, unknown or other
  modified_base (411)..(411): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgctgannnnnnngtcgcgngcgacgtacgacgcgcggcgcggcggcgctccnnntntntatctctatntatctntatnacanacncacncacncncnnncncgcncgcncgcgcncgcgcgcgcgcgcgcgcgtcgcgtcgcncncncncncgaccncnccgccacgaacacaacacacacaacgaacgaacg

SEQ ID NO: 418190 - DNA, 561 bp, Homo sapiens
  misc_feature: GZ8MTXP01BLHRZ.21.78.H01.1.454.CMB.2.raw
  modified_base (356)..(356): a, c, t, g, unknown or other
  modified_base (445)..(445): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggctccgagggaggcctggagtggatctctacttatttatagtggtgtaccccanatactacacaagactccgtgaacgggccgattcacatctcagaagactaatccaggaaacacattgtatcttacaaatgaataactganagccgagacacggcatcgtattacgtgtggtgggctagtttcgtcgaacccgggttgggggcccgggacccgtgggtccaaccgtcctcccccgaccctccgaacccgtaaccggg

SEQ ID NO: 418191 - DNA, 583 bp, Homo sapiens
  misc_feature: GZ8MTXP01CU47Q.21.78.H01.1.454.CMB.2.raw
  modified_base (342)..(342): a, c, t, g, unknown or other
  modified_base (356)..(356): a, c, t, g, unknown or other
  modified_base (548)..(548): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgcgaggcctccgaggggaggcctggagtggatctcacttattanagtggtgtacccanatactacacaagactccgtagaaacgggccgatccacatctacagaagacaattccaaggaacacattagtattctacaaatagaaataacctagaagacgacgaaggacgacggacctatacgtattacgtgtggtggggctacgttacgtcggtaccccgttcgggggcccgggttaacccgtggtaccnccgtccctccccgaccctcccgaaccgaacccggg

SEQ ID NO: 418192 - DNA, 564 bp, Homo sapiens
  misc_feature: GZ8MTXP01A3KRN.21.78.H01.1.454.CMB.2.raw
  modified_base (480)..(480): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaagggcctggagtggatctcacttatttatagtggtggtaccccacatactacacaagactccgtgaaagggccattcacatctacagaagacaattccaggaaacactattgatcttacaaattgaaactaacctgaagacgaccgaaggacacggaccatgtattacnggtgtggggctatttcgtcgaccccgttgggggcccgggaaccctgggtccaaccgtcctccccaccctccgaaccgaaccggg

SEQ ID NO: 418193 - DNA, 630 bp, Homo sapiens
  misc_feature: GZ8MTXP01CT8G5.21.78.H01.1.454.CMB.2.raw
  modified_base (471)..(471): a, c, t, g, unknown or other
  modified_base (588)..(588): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcgagtggcgactacatgagctgggtccgcaggctccgagggacgggcctggagtggatcgtctactttatttagtagttggtacggtaccccacgtatacgtaacaccaaagaccttcccggtagaaacggggcccgtaattccaaccgtatctacaagaaagaacaattaccaaggaaactacgattagtattactanaaatagaaataacctggagacgccgaaggaccacggaccatcgtattacgttggtggtggggcttatttacgttacggaccccgttcgggggcccgggttaaacccgtgggtacccncccggttcctcccccgacccttccccgaaccgtaacccgggg

SEQ ID NO: 418194 - DNA, 603 bp, Homo sapiens
  misc_feature: GZ8MTXP01AQEHZ.21.78.H01.1.454.CMB.2.raw
  modified_base (359)..(359): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggcctggagtgggatctctacttatttatagtggtggtaccccanatactacacaagactccgtgaaagggccgattcacatctcagaagacaattccaggaacacattgtatctacaaatagaataacctgagagaccgaggacacggaccatgtattacgtggtgtgggggttctaagtttacgtcggtaaccccggttcggggggcccggggttaaaccccgtcgggtcccgaacccgttccccgtccccccgacccctaaccccgttaacccgtaaaccccgggg

SEQ ID NO: 418195 - DNA, 613 bp, Homo sapiens
  misc_feature: GZ8MTXP01BR7NE.21.78.H01.1.454.CMB.2.raw
  modified_base (264)..(264): a, c, t, g, unknown or other
  modified_base (353)..(353): a, c, t, g, unknown or other
tcagtcgtcgctcgcacgaccggtgctcgatttagtgtgagtagtttgggtttgggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctntgggttcgcaggtgcgactacatgagctgggtccgcaggctccgaggaggcctggagtggatctcacttattatagtggtgtaccccanatactacacaagactccgtagaaacggggcctattcaccatctacagaagacaattcccaaggaaccacgtattacgtatcttacaaatcgaaataacctgaacgacgccgaaggaccgaggacccaagtcggtaattacgtggttgggtggggttctaacgttttacgtcgtacccccgggttcgggggcccggggttaaacccttgggtccctaacccggtcctacccccggttaccctcccgaaccgtaacccgggg

SEQ ID NO: 418196 - DNA, 573 bp, Homo sapiens
  misc_feature: GZ8MTXP01AWZGM.21.78.H01.1.454.CMB.2.raw
  modified_base (365)..(365): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttcctgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgagggaagggcctggagtgggatctcacttatttatagtggtggtaccccacatactanaccaagactccgtagaagggccattcgacatctacagaagacaattccaaggaacacattgatcttacaaatcgaaataacctgaagacgaccgaggacacggacatggtaattctgtggtggggctaattttcgtcggtaccccgttgggggcccgggaacccgtggttaccaacccggtcctccccaccgtccaaccgaacccggg

SEQ ID NO: 418197 - DNA, 555 bp, Homo sapiens
  misc_feature: GZ8MTXP01EZC05.21.78.H01.1.454.CMB.2.raw
  modified_base (412)..(412): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggtttttccttgttgctatttcaaaaggtgtccagtgtgaggtgcagttggtgagactggagaggcttgatccagccgtggggggtccctgagactctcctgtgcagtctctgggttcgtcagtggcgactacatgagctgggtccgccaggctccgagggaaggggcctggagtggatctcacttatttatagtggtggtaccccacatgctacaacagctccgtgacgggccgattcacatctcagaagacaatacagaanacatgtatacttcaatagataacctgagacgccgaggacgacgccgatagtatactgtgttggggtcttattaccgttttaccccgttcggggcccggggtaacccgtcggtccacccgtccttccccaaccccttcccgccc

SEQ ID NO: 418198 - DNA, 719 bp, Homo sapiens
  misc_feature: GZ8MTXP01B6ZCF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtcctgagactctcctgtgcagtctcgtgggttcgtcgaggtggcgactacatgagcgtcgggtccgccgaggcctccggaggggaacgggcctgggagtggatctctactttatttagtaggtggtacgtaaccccatatactacacaagactcggtagaacgggcctatcacatactacaagaacgactaattaccaaggaaacactattagtacttacttaacaaaagttagaaacttaaaccgtggaacgaacggacccggaaggaaccgaccggtacctaaggttacgttaactttaacggtgggttaacggggttcgggggttacctttaaacggtttttaaccggtaccggggtaaccccccgggggttaggggggggttacccccgggggttaaaccccgttcgggggtacccctaaccccgggttccccctacccccccgttaccccgtaacccgaaaccccgggtaaccccgggg

SEQ ID NO: 418199 - DNA, 642 bp, Homo sapiens
  misc_feature: GZ8MTXP01CPGD4.21.78.H01.1.454.CMB.2.raw
  modified_base (363)..(363): a, c, t, g, unknown or other
  modified_base (454)..(454): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagcgtgggggtccctgagactctcctgtgcagtctcgtgggttcgtcagtggcgactacatgagcgtcgggccgccgaggcctcggagggaggccgtggagtggatctactactttattagtaggtgtcgtaccccanatacgtacacaagactccgtaggaacgggccgtatccactatctacaagaacgactaacttaccaaggaacacgtattcgtaattcctaanaaaagtgaaactaacgtggaacgacggaccgaaggaccacgggtaccagttagtagttacgtggtcgggtaggggacttacgtttaccgtaccgggtccccgggttacggggggaccccgggttaccttccgggtacccgaacccgttcccgacccccttaccccgtaaccgaacccgtaacccgggg

SEQ ID NO: 418200 - DNA, 568 bp, Homo sapiens
  misc_feature: GZ8MTXP01B6DYL.21.78.H01.1.454.CMB.2.raw
  modified_base (542)..(542): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgaggggaagggcctgggagtggatctcacttatttatagtggtggtaccccacatactacacaagactcgtgaaacgggccgattcaccatctcagaagacaattccaaggaacacattgtatcttacaaatgaaataactgagagccgaagacacggaccatgtattactggtgtggggctactttcgtcgtaccccgttgggggcccgggttaaccgtgggtccaaccgtcccncccgacccctcccgaaccgaaccggg

SEQ ID NO: 418201 - DNA, 721 bp, Homo sapiens
  misc_feature: GZ8MTXP01AVZPM.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccaggcctccgaggggaagggcctgggagtggatctctactttatttataggtggtgtaccccacatactacacaacgactccggtagaacggggccctattccaacccattcctacgaagaaacgaactaacttacccgaagggaaaccctacgtaattcgttaacttacttaactaaaagttagaaaacttaaccgtaggaagaacggaccccggaagggaccaaccgggaccctaagttggttaactttaacgttgggtaagggttacgggggactttaaacgttttacccggttaccgggtacccccgggttacgggggggacccccggggttaaacccgttcggggttaccccgtaaccccggttccccttaccccccccgaaccccgttccccgaaaccccgggtaaccccgggg

SEQ ID NO: 418202 - DNA, 591 bp, Homo sapiens
  misc_feature: GZ8MTXP01EFAFX.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgcgaggcctccgagggaagggcctgggagtggatctactactttatttatagtggtcgtaccccacatactacacaagactcgtgaagggccattcaccatctacagaagacaattccaaggaacactattcgtatctacaaatgaaactaactgagacgaccgagacacggccagtcgtattactgtggtgggactatttacgtacggaccccgttgggggcccgggttaaacccgttgggcccctaacccggttccctacccccgacccttccccgaaccgaacccgggg

SEQ ID NO: 418203 - DNA, 572 bp, Homo sapiens
  misc_feature: GZ8MTXP01BR2BH.21.78.H01.1.454.CMB.2.raw
  modified_base (539)..(539): a, c, t, g, unknown or other
  modified_base (547)..(547): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaagggcctggagtggatctctactttatttagtagtggtgtaccccacatactacacaagactcgtgaagggccgattcaccatctcagaagacaattccaaggaacactattgtaatcttacaaatgaaactaactgaagacggaccgaggaccacggaccagtgtattacgtgtggtgggctagtttcgtcggtacccgttgggggcccgggaccgtgggtccnccgtcccnccccaccctccgaaccgtaacccgg

SEQ ID NO: 418204 - DNA, 580 bp, Homo sapiens
  misc_feature: GZ8MTXP01B8AMT.21.78.H01.1.454.CMB.2.raw
  modified_base (391)..(391): a, c, t, g, unknown or other
  modified_base (427)..(427): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgagggaagggcctggagtggatctcactttatttatagtggtgtacccacatactacacaagactccgtgaagggccatcacanctcagaagacaattccaaggaacacattgatcttanaaatgaaactaaccgtgaacgacgccgaaggaccgacggccattggtaattacgtgtggtggggctatttacgtcggaccccgttgggggcccgggttaaccctgggtacccaacccgtcctacccccgacccctccgaaccgtaacccgggg

SEQ ID NO: 418205 - DNA, 624 bp, Homo sapiens
  misc_feature: GZ8MTXP01DCWET.21.78.H01.1.454.CMB.2.raw
  modified_base (589)..(589): a, c, t, g, unknown or other
tcagtcgtcgctcgcacgaccggtgctcgatttagtgtgagtagtttgggtttgggggggagaggagccccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagctgggtccgcaggctccgagggaggcctggagtggatctctactttatttatagtggtgtacccacatactacacaagactcgtgaacgggccgattccactatctacaagaagacaacttccaaggaaaccactattgtattcttacaaatacgtaaactaaccgtgaacgacggccgaaggaccacgggacctattggttaacttcgttggtggtcggggactagtttttaaccgtcggtaccccgggttggggggccccggggttaaacccttcgggtaccctcccggttccccnccccccgaacccttcccgaaccccgtaacccgggg

SEQ ID NO: 418206 - DNA, 566 bp, Homo sapiens
  misc_feature: GZ8MTXP01CT3II.21.78.H01.1.454.CMB.2.raw
  modified_base (400)..(400): a, c, t, g, unknown or other
  modified_base (474)..(474): a, c, t, g, unknown or other
  modified_base (539)..(539): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggcctccgaggggaacgggcctggagtggatctcactttattatagtggtgtaccccacatactacacaagactccgtgaacgggccatcacatctanagaagacaattccaggaacactattgtatctacaaatgaaatactgagacgccgagcacggccatgtattacgnggtgtggggctagtttcgttcggaccccgttgggggcccgggacccgtcggtccaacccggtccnccccgaccctccgaaccgaacccgggg

SEQ ID NO: 418207 - DNA, 593 bp, Homo sapiens
  misc_feature: GZ8MTXP01C79N2.21.78.H01.1.454.CMB.2.raw
  modified_base (302)..(302): a, c, t, g, unknown or other
  modified_base (373)..(373): a, c, t, g, unknown or other
  modified_base (424)..(424): a, c, t, g, unknown or other
  modified_base (438)..(438): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtggggggtccctgagactctcctgtgcagtctcgtgggttctcgagtggcgactacatgagctgggtccncaggcctcggagggaacggcctggagtggatctcatttattatagtggcgtaaccccatatactacacaanactccgagaacgggcatccaccatcacaagaagacaaactcaaggaacatnttatatccttaaanaaatagaaacgtaacgtagacgacgacgacgacgacgactagtagtactagtggtgggtcggttacttacgttaccgtccggacccgggttcggggacccggaccgtcggtaccctaacccgtcccaccccgaccctaacccgaaccggtaaccg

SEQ ID NO: 418208 - DNA, 546 bp, Homo sapiens
  misc_feature: GZ8MTXP01D1TSB.21.78.H01.1.454.CMB.2.raw
  modified_base (521)..(521): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtgggatctcacttatttatagtggtggtaccccacatactacacaagactccgtgaaacgggccattcaccatctcagaagacaattccaaggaaacacattgtatcttcaaatgaaataacctgaagagccgagacacggccatgtattactgtgtgggctatttacgtgaccccgttggggcccgggaacctggtcnccgtctccccacctccaacgaacgg

SEQ ID NO: 418209 - DNA, 574 bp, Homo sapiens
  misc_feature: GZ8MTXP01C3RGF.21.78.H01.1.454.CMB.2.raw
  modified_base (458)..(458): a, c, t, g, unknown or other
  modified_base (546)..(546): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtcccgccaggctccgaggggaagggcctggagtgggatcgtcactttatttataggtggtggtacccccacatactacacaagactccgtagaaacgggccgattcaccatcctcaagaagacaattccaaggaacactattgatctacaaatgaataacctganagccgagacacggccatgtatactgtgtgggctatttcgttcgaccccgttgggggccccgggaaccgtcgggtaccaacccggtccncccccgaccctcccgaaccgaacccggg

SEQ ID NO: 418210 - DNA, 579 bp, Homo sapiens
  misc_feature: GZ8MTXP01CTL00.21.78.H01.1.454.CMB.2.raw
  modified_base (215)..(215): a, c, t, g, unknown or other
  modified_base (436)..(436): a, c, t, g, unknown or other
  modified_base (442)..(442): a, c, t, g, unknown or other
  modified_base (474)..(474): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggtttcctgttgctatttcaaaaggtgtccagtgtgaggtgcagttggtggagactggaggaggntgatcagcgtcgggggtccgtgagactctctgtgcagtctcgtgggttcgtcgagtggcgactacatgagcgtcgggtccgccgacggcgtccgaacgggaacgggcgtggagtggatctctacttattatagtggtgtaccacatactacacaacactcgtagaagggacgactacacactacacagaagaacaatacaacgaacaactatatatactanaaatanaaataaactagagagacgacgacgacgacatntatactgtggtgggttgtacttacgttacgtacccggttccggggccgggacccggtaacggtccgtaaccgtccctaccccacccctaacccgaacccgaaccg

SEQ ID NO: 418211 - DNA, 582 bp, Homo sapiens
  misc_feature: GZ8MTXP01EVF7L.21.78.H01.1.454.CMB.2.raw
  modified_base (360)..(360): a, c, t, g, unknown or other
  modified_base (410)..(410): a, c, t, g, unknown or other
  modified_base (441)..(441): a, c, t, g, unknown or other
  modified_base (447)..(447): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtcccgccaggctccgaggggaagggcctggagtggatctctacttattatagtggtggtaccccanatactacacaagactccgtagaacggggccattccaccatctacagaaanacaattccaaggaacatattgtatcttaaanaaatanaacgtactgagacgacgagacacgacatgtatcgtgtggtggttctacgtttacgtccggacccgggttcgggggcccggttaccgtcggtaccctcccgtccctaccccacccgtaacccgaacccgtaaccgg

SEQ ID NO: 418212 - DNA, 613 bp, Homo sapiens
  misc_feature: GZ8MTXP01BRTXH.21.78.H01.1.454.CMB.2.raw
  modified_base (365)..(365): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccaggctccgaggggaaggccgtggagtggatctctactttatttatagtggtcggtaccccanatactacacaagactccgtagaacgggccattcaccatctacagaagacaattccaaggaaccactattgtatcttaacaaatagaataaccgtgagacgccgaaggacacggacctatgttattactggtaaggtggggctagtttacgtccggtaccccggttcggggggccccggggttaaccccgttcgggtaccctccccgttccctccccccaccccgttcccgaaccccgtaaccccgggg

SEQ ID NO: 418213 - DNA, 559 bp, Homo sapiens
  misc_feature: GZ8MTXP01CFFTC.21.78.H01.1.454.CMB.2.raw
  modified_base (354)..(354): a, c, t, g, unknown or other
  modified_base (388)..(388): a, c, t, g, unknown or other
  modified_base (394)..(394): a, c, t, g, unknown or other
  modified_base (529)..(529): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgaggggaggcctggagtggatctcacttattatagtggtgtaccccanatactacacagactcgtagagggccatcacatcncagaanacatccagaacactattgtactcttacaaatgaaactaactgagacgaccgagacacggactattatatcgtggtggtggttcttagttcgtacccggccgggttcggggcccgttacgtcgaccctccgtcccnccccttaccctaaccgaaccggtaacccgg

SEQ ID NO: 418214 - DNA, 617 bp, Homo sapiens
  misc_feature: GZ8MTXP01C7V0L.21.78.H01.1.454.CMB.2.raw
  modified_base (330)..(330): a, c, t, g, unknown or other
  modified_base (356)..(356): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgagggagggcctggagtggatctnactttatttatagtggtgtaccccanatactacacaagactccggtagaacggggccgtattccaccatctacaagaaacgacaattaccaaggaaacactaatttagtaacttcttaacaaatacgaaattaacctgaagacgacgaggacacggaccatagtattacgtgtgtggggctagtttacgtcgtaccccggttcgggggcccggggttaaaccccttcggggtaccctaacccggttccctaccccccgttaccccgtcccgaaccccgtaacccggg

SEQ ID NO: 418215 - DNA, 623 bp, Homo sapiens
  misc_feature: GZ8MTXP01EF2M2.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcaggctccgaggggaagggcctggagtggatctctactttatttataggtgtcggtaaccccatatactacacaagacctccgtagaaacgggccgattccaccatctacagaagacaattaccaagaacactattgtatacttaacaaatagaaactaacctagaagacgaccgaaggacgacggaccatacgtattacgtgttaaggtggggttactagtttacgttcggtaccccgggttcgggggcccggggttaacccgtcgggtacccgtaacccggttcccctacccccacccctccccgaacccgtaaccccggg

SEQ ID NO: 418216 - DNA, 699 bp, Homo sapiens
  misc_feature: GZ8MTXP01BTRT4.21.78.H01.1.454.CMB.2.raw
  modified_base (277)..(277): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgaggccgtgggggtccctgagactctcctgtgcagtctcgtgggttcgtnagtggcgactacatgacgcgtcgggtcccgcgaggcctaccggaggggaacgggcccgtagggaggtgggtactcgtactaactttagtttagtaggttgggtacggtaacccccaactaataacctacaacgaagtacctccggtagaaacggggccctaacgttccaacctagtcctacgaaagaaacgaactaacgttaccgaaaggtaaacctactagttagtacttacttaacgtaaatacgtaaactaaccgtggaacgacgccgaagaccacggacctagtagtacttacgtggtcggtagggacttacgtttaccgtaccggtaccccgggttgggggccccggttaacccgttcgggtaccccgtaacccgttccccacccccgttaccccgtccgaaacccggtaacccggg

SEQ ID NO: 418217 - DNA, 568 bp, Homo sapiens
  misc_feature: GZ8MTXP01CCV52.21.78.H01.1.454.CMB.2.raw
  modified_base (456)..(456): a, c, t, g, unknown or other
  modified_base (544)..(544): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtcccgccaggcctccgagggaagggcctggagtggatctcactttatttatagtggtggtaccccacatactacacaagacctcgtgaacgggccgatcacatctacagaagacaattccaaggaaacactattgtaatcttacaaatgaaataactganacgccgaaggcacggcatgtattactgtggtgggctagttacgtcggtcccggttgggggcccgggaaccctgggtcaacccggtccnccccaccctccgaaccgaaccggg

SEQ ID NO: 418218 - DNA, 581 bp, Homo sapiens
  misc_feature: GZ8MTXP01AZKX2.21.78.H01.1.454.CMB.2.raw
  modified_base (424)..(424): a, c, t, g, unknown or other
  modified_base (502)..(502): a, c, t, g, unknown or other
  modified_base (507)..(507): a, c, t, g, unknown or other
  modified_base (511)..(511): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcaggtggcgactacatgagcgtcgggtcccgccaggcctccggaggggacgggcccgtgggagtggatcctactactttatttactaggtggtacggtaaccccactatactacacaaagacctccggtagaaacggggccattcacatctanagaagacaacttcaagaacactattgtaatctaacaaagtgaaactactagagacgccgagacgacgcatgtattacngtggngggntagttcgtcgacccggttggggcccgggttacctggccaaccgtcctccccgacctcgaaccgtaaccgg

SEQ ID NO: 418219 - DNA, 572 bp, Homo sapiens
  misc_feature: GZ8MTXP01EZKYC.21.78.H01.1.454.CMB.2.raw
  modified_base (431)..(431): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttctcagtggcgactacatgagctgggtccgccaggctccgagggagggctggagtggatctctacttattatagtggtggtaccccacatactacacaagactccgtagaagggccattcgaccatcctcaagaagacaattccaggaaacactattgtatctanaaatgaataactgagacgacgagacacggacatgtatacgtgtggtggggctatttacgtcggacccgttcgggggcccgggttaacccgtcgggtccaacccggtccctcccccgaccctaacccgaacccgaacccggg

SEQ ID NO: 418220 - DNA, 597 bp, Homo sapiens
  misc_feature: GZ8MTXP01AIQN8.21.78.H01.1.454.CMB.2.raw
  modified_base (365)..(365): a, c, t, g, unknown or other
  modified_base (487)..(487): a, c, t, g, unknown or other
  modified_base (565)..(565): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgagcgtgggtccgccaggctccgaggggaagggcctggagtggatctctactttatttatagtggtacgtaccccanatactacacaagactcgtagaacgggccgattcacatctacagaagacaacttaccaaggaacactattgtatcttacaaatgaaactaactgagagaccgaggacacggacatgtaattcnggtgtggggactagtttacgttcggaccccggttcgggggcccgggttaaccccgtggggtcccaacccggttccccncccccgacctaaccccgaaccggaaccccggg

SEQ ID NO: 418221 - DNA, 648 bp, Homo sapiens
  misc_feature: GZ8MTXP01D58F6.21.78.H01.1.454.CMB.2.raw
  modified_base (300)..(300): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcagtggcgactacatgagcgtgggtcccncgaggctccgagggacggcctggagtggatcgtctactttattataggtggtacgtaccccagtaatactacacgaacgactccggtagaaacggggtcccattaccacctatctacgaagaaacgactaaacttaccgaagtaaacactattagtaactcttaacaaatagaaactaacgtgaacgacggaccgaacggacgaaccgactagtgttacttacgtggtggtcggggttactacgttttaccgtcggtaccccgggttagggggccccgggttaaacccgtcggggtacccaaccccggttcccacccccgttacccgtccccgaacggtaaccccggg

SEQ ID NO: 418222 - DNA, 676 bp, Homo sapiens
  misc_feature: GZ8MTXP01C0OL6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagtcgtgggtcccgccgaggcctccgaggggaacgggccgtggagtggatctctactttatttataggtggtacggtaaccccacatactaacacaacgactcgtagaaacgggccatccaccatctacagaaacgaactaacttccaaggaaccactattgtaattctaacaaattacgaaactaaccgtgaagacggccgaaggaccacggacctagtagttacttacgtggtgggttcggggacttaacgtttaccggttacccgggaccccgggtttacggggggccccggggttaaaccccgttcgggggtacccctaacccccgggtttcccctacccccccggaaccccgttaaccccgaaccccgggtaaaccccgggg

SEQ ID NO: 418223 - DNA, 610 bp, Homo sapiens
  misc_feature: GZ8MTXP01A1DKW.21.78.H01.1.454.CMB.2.raw
  modified_base (484)..(484): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtcgggtccgccgaggcctccgaggggaagggccgtggagtggatctctacttatttatagtggtgtaccccacatacgtacacaagacctcgtagaacgggccacttcacatcacaagaaacgactaacttaccgaaggaaacactaattgtatacttacaaatagaactaaccgtgaacgacgaccgaggacncgggaccagtagtattcgtggtggtagggttctagtttaccgtcggaaccccggttgggggccccgggttaccgtcgggtccctaacccggtccctcccccgaccctcccgaacccgtaacccggg

SEQ ID NO: 418224 - DNA, 593 bp, Homo sapiens
  misc_feature: GZ8MTXP01BWAMI.21.78.H01.1.454.CMB.2.raw
  modified_base (499)..(499): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcggggtcccgccaggcctccgaggggaagggcctggagtggatctcactttattatagtggtgttaccccatatactacacaagactccgtagaacgggccattccaaccatcctacaagaaacgacaattccaaggaaacactattgtatcttacaaatgaaataccgtgacgagccgagacacggccagtgtattacgtggtggngggttctacttttacgtcggaaccccgttggggggacccggacccgtgggtcccaacccggtccctaccccgaccctcccgaaccgtaacccgg

SEQ ID NO: 418225 - DNA, 585 bp, Homo sapiens
  misc_feature: GZ8MTXP01AVSZL.21.78.H01.1.454.CMB.2.raw
  modified_base (355)..(355): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgcaggctccgagggaggcctggagtggatctcacttatttatagtggtgtacccanatactacacaagactccgtgaacgggcatcacatctacagaagacaattccaaggaacactattagtatacttacaaatagaaactaactgaagacgccgaggacacggcctatgtattacgtggtggtcggggctagtttacgtcggaaccccggttgggggaccccggggttaaccctgggtacccgaacccgttccctcccccgaccctcccgaaccgaacccgggg

SEQ ID NO: 418226 - DNA, 571 bp, Homo sapiens
  misc_feature: GZ8MTXP01BGKR6.21.78.H01.1.454.CMB.2.raw
  modified_base (359)..(359): a, c, t, g, unknown or other
  modified_base (404)..(404): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggagggcctggagtggatctctacttatttatagtggtgtaccccanatactacacaagactcggtgaaacgggccattcacatctcagaanacaattcaagaacactattgattctacaaatgaataactgagagcgagcacggcatgtatactggtggtggggactagtttacgtcggtacccggttcgggggcccgggttacccgtcgggtcccgaacccgtccgtcccccacccgtcccgaacccgtaacccggg

SEQ ID NO: 418227 - DNA, 731 bp, Homo sapiens
  misc_feature: GZ8MTXP01DQ1XO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgacgactctcctgtgcagtctgtgggttcgcaggtggcgactacatgagcgtgggtcccgccgaggcctccgagggaaggcctgggagtggatcgtactactttatttagtaggtggtacggtaacccccatatactacaacaacgtactccggtagaaacggggccctattccaacctatcctacaagaaagaacctaaattcccgaaaggaaacctatatttagtaacttctaaactaaagtagaaacttaaacgaggaacgaacgaccggaacgggaccaacggggtacctaagttgttaactttaccgtgggtcggttacggggactttaaacgttttaacccggttacccgggaacccccggggttacggggggggttaccccggggaaaccccgtttcggggttaacccccgtaaccccgggttaccccctacccccccgttaaccccgttaacccccgaaacccggtaaacccccggggg

SEQ ID NO: 418228 - DNA, 648 bp, Homo sapiens
  misc_feature: GZ8MTXP01DBXUL.21.78.H01.1.454.CMB.2.raw
  modified_base (196)..(196): a, c, t, g, unknown or other
  modified_base (275)..(275): a, c, t, g, unknown or other
  modified_base (358)..(358): a, c, t, g, unknown or other
  modified_base (376)..(376): a, c, t, g, unknown or other
  modified_base (415)..(415): a, c, t, g, unknown or other
  modified_base (421)..(421): a, c, t, g, unknown or other
  modified_base (457)..(457): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtcagtgtgaggtgntaggttggtggagacgtgggaggagcttgatccagccggtcgggggtcctgagactctcctgtgcagtctcgtgggtcncgagtggacactacagtgagcgtgggtcccgcgaggccaccggaaggggaacggccgtagggagtgatctactaatttattanaggtggtacgtaacccanataacacacaaagctcgagaaacgggccatccacatcanaagaanaacaataccgaagaaactatattatactacttaaanaaataagtaaacgtaacgtaggaacgacggaccggtaagaaccgacgtactagttagttagttacgtggttgggtagggttacttacgtttaccgtaccgggtacccggggttacgggggaccccggttaccgttccggtccctaaccccgtccccacccccgttacccgtaacccgaacccggaacccgg

SEQ ID NO: 418229 - DNA, 603 bp, Homo sapiens
  misc_feature: GZ8MTXP01A4EE1.21.78.H01.1.454.CMB.2.raw
  modified_base (407)..(407): a, c, t, g, unknown or other
  modified_base (577)..(577): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgacgcgtgggtccgcaggcctcgagggacggcctggagtggatctactactttatttataggtggtacgtacccacatactacacaaacgactccgtagaacgggccattcaccatcctanaagaacgacaattccaaggaaacataattgtaactcttaacaaaattgaaacttaaccgtgaacgacgaccggaggacacgggaccagtagtattacgtgtggtcggggctacgtttacgtcggaaccccgttcgggggcccgggttaaccctgggcctaacccgtcccnccccaccctcccgaaccgtaacccgg

SEQ ID NO: 418230 - DNA, 602 bp, Homo sapiens
  misc_feature: GZ8MTXP01BYZQ6.21.78.H01.1.454.CMB.2.raw
  modified_base (356)..(356): a, c, t, g, unknown or other
  modified_base (365)..(365): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttctcaggtggcgactacatgagctgggtcccgcaggctccgagggagggcctggagtggatctcactttatttatagtggtgtaccccanatactacanaagactccgtgaaacgggccattcaccatctacagaagacaattaccaggaacacattgatcttacaaatgaaagtaacctgaagacggaccgaggaccacggccaagtcgttattactgtggtggggctacgtttacgttaccggtccccggttacgggggcccggggttaaaccccgtcgggtccaaccccggttccctccccccgaccccgttccccgaacccggaaacccggg

SEQ ID NO: 418231 - DNA, 596 bp, Homo sapiens
  misc_feature: GZ8MTXP01EIZVF.21.78.H01.1.454.CMB.2.raw
tcagtcgtcgctcgcacgaccggtgctcgatttagtgtgagtagtttggttttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaagggcctggagtggatctcactttatttatagtggtggtacccacatactacacaagactccggtgaaagggccattcaccatctacaagaagacaattccaaggaaacactatttgaatcttacaaatcgaaataaacctgaagagcccgaaggaccacggaccagtgtattcgtggtggtcggggactagtttacgtcggtaccccgttggggggcccggggaacccctgggtaccctaacccgtcccgtacccccaccccgtccccgaaccgtaacccgggg

SEQ ID NO: 418232 - DNA, 580 bp, Homo sapiens
  misc_feature: GZ8MTXP01CUGHC.21.78.H01.1.454.CMB.2.raw
  modified_base (405)..(405): a, c, t, g, unknown or other
  modified_base (546)..(546): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcaggctccgaggggaagggcctgggagtggatctctactttatttataggtggtggtaccccacatactacacaacgactccgagagggccgatcacatctcagaanacaatccaggaacactattgtaacttctactaaatagaaataactagagacgaccgacggacgacggaccagtagtagttctggtggtggggttctagtttacgttcgaccccggttcgggggcccgggacccgtggtccnccgtcctccccgaccctcccgaaccgaacccggg

SEQ ID NO: 418233 - DNA, 703 bp, Homo sapiens
  misc_feature: GZ8MTXP01DOVRF.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttctcgagtggcgactacatgagcgtcgggtcccgcgaggcctccgaggggaacgggcctagggagtggatcgtactactttatttagtagtggtacgtaccccactatactacacgaaacgacctccggtagaaacgggcctattcccaacctatccctacaagaaacgaacctaaattcccgaaaggaaacctactagtttagtacttacttaacaaaattacgaaacttaaacccgtaggaacgacgaccggaagacgaccggtacctagttgttaacttacgtggttaagggtcggggttacttacgttttaccgtaccgggtacccccgggttacggggggccccggggttaaaccccgttggggtacccctaaccccggttccccgtacccccccaaccccgttccccgaaacccgtaacccccggggg

SEQ ID NO: 418234 - DNA, 693 bp, Homo sapiens
  misc_feature: GZ8MTXP01C0WV2.21.78.H01.1.454.CMB.2.raw
  modified_base (478)..(478): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcaggtggcgactacatgagcgtcgggtcccgcaggctccggaggggaacgggccgtgggagtggatcgtctactttatttagtaggtggtacggtaccccactatactaacacaaacgtacctccggtaggaaacgggcctacttccaacctatctacaagaaacgactaacgttaccaaggaaacacgtattagtactacttanaaaatagaaacgtaacctaggaagacgaccgaacggacgacggacctagtagttaactacggtgtaaggtcggggttacttaacgtttaccgttaccgggaccccgggttacggggggttaccccgggggttaaccccgttcggggtaccccgtaaccccggttccccgtaccccccttaaccccgttaaccccgaaccccggtaaaccccgggg

SEQ ID NO: 418235 - DNA, 552 bp, Homo sapiens
  misc_feature: GZ8MTXP01DR0YS.21.78.H01.1.454.CMB.2.raw
  modified_base (424)..(424): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagctgggtccgcaggctccgagggaaggcctggagtggatctcacttatttatagtggtagtacccacatactacacaagactccgtagaaagggcccgatcacatctcagaagacaatccaggaacacattgatntacaaatagaataaacctgagagccgagacacggaccatgtattactgtaagtggggctatttacgtcgacccgttggggccgggaaccctgggtccaaccgtctccccacctccgaaccgaaccggg

SEQ ID NO: 418236 - DNA, 618 bp, Homo sapiens
  misc_feature: GZ8MTXP01CSQ1J.21.78.H01.1.454.CMB.2.raw
  modified_base (358)..(358): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagctctcctgtgcagtctcgtgggttctcagtggcactacatgagcgtggtccgcaggcctccgagggaggcctggagtggatctcactttattataggtggtcgtaaccccanactactacacaacgactcccgaggaacgggccgattcaccatcctacaagaagaacattacccaaggaacactattagtatacttacaaaatgaaataaccgtagaacgaggacccgaaggaccacggacctaatgttaattacgtggtgggtggggcttacgtttccgtacggccccggttacggggggcccggggttaacccttcgggtacccaacccggttccctaccccgacccctaacccgaaccgaaccccggg

SEQ ID NO: 418237 - DNA, 707 bp, Homo sapiens
  misc_feature: GZ8MTXP01DE6PY.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgagttggtggagacgtggaggaggcttgatccgagccggtgggggtcctgagactctcctgtcgctagtctcgtgggttctcgagtggcgactacagtgagccgtcggccgacgaggccgtaccggaagggaacgggccgtaggagtggtactcgtactaacgtttatttagtaggtggtacgtaaccccataatactaacacgtaaacgacgtcggtaggaaacgggtcctaattaccaaccattaccacgaaagtaaacgaaacctaattacccggaaaggtaaaaccctacttagtttacgtaacttaccgtttaaaaaataaaagttaacgtaaacgttaacgtaggaacgaccggacggaacgtaccgaacggtactaagttagttacgttacggtggtggtacgttacttacgttccggtacccgggacccgggttaccggggacccgttaccgtcgtaccccgtaacccgtccccaccccgttaccctaacccgaacgtaaccg

SEQ ID NO: 418238 - DNA, 593 bp, Homo sapiens
  misc_feature: GZ8MTXP01DWHYH.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgcaggctccgagggaggcctggagtggatctctactttatttatagtggtacggtaccccatatactacacaagactccgtagaacgggccatcacatctacagaagacaattaccagaaacactattgtatctacaaatgaaataactgaagagccgagacacggaccatgtaacttactggtggtcgggctagtttacgtcggtaaccccggttcgggggacccgggttaccccgtggtccctaaccccggtcctaccccccgttacccgtccccgaaccgtaaccccggg

SEQ ID NO: 418239 - DNA, 740 bp, Homo sapiens
  misc_feature: GZ8MTXP01ECZ6N.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgtagttggtggagacgtggaggaggcttgatccagccgtgggggtccctgagactctcctgtgcagtctcgtgggttcgtcgaggtggcgactacatgagcgtcgggtccccgccgacggccgtacggagggaacgggcctagggagtggatctactaactttatttagtaggtggtacgtaccccatatactacacaacgacctccggtagaaacgggcccgtattcccaacctataccctacgaaagaaacgaactaaacgttacccgaaaggtaaactaacttattagtaacttacttaaactaaaagttacgtaaaacgttaaacccgtaggaaacggaaccggacccggaaacggaacccgaacgggacctaagttacgttaaacttacgtgggttaaggtacggggttacttaacggttttacccgtaccggtacccccggggttacgggggttaccccggggttaaaccccgttcgggtacccctaaccccggtcccctaccccccacccgtaaccccgaacccggtaaaccccggg

SEQ ID NO: 418240 - DNA, 584 bp, Homo sapiens
  misc_feature: GZ8MTXP01DHHV4.21.78.H01.1.454.CMB.2.raw
  modified_base (366)..(366): a, c, t, g, unknown or other
  modified_base (415)..(415): a, c, t, g, unknown or other
  modified_base (467)..(467): a, c, t, g, unknown or other
  modified_base (502)..(502): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtggggggtccctgagactctcctgtgcagtctcgtgggtcgtcgagtggcgactacatgagcgtgggtccgcaggctccgagggaaggccgtggagtggactctctactttatttatagtggtacgtaccccanatactacacaagactccgtgaacggggacctatccacatctacaagaanaactaatccaaggaacactatagtaatcttaacaaatagaaataacctgaanacgccgagacacggaccatgtatactggtgtgggntattcgttcggacccgttgggggcccgggaacccgttgggacccaaccggttccaccccacctaacccgaacgtaacccggg

SEQ ID NO: 418241 - DNA, 672 bp, Homo sapiens
  misc_feature: GZ8MTXP01AIS0N.21.78.H01.1.454.CMB.2.raw
  modified_base (370)..(370): a, c, t, g, unknown or other
  modified_base (411)..(411): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccaggcctccgaggggaacgggcctggagtggatctctactttatttataggtggtacggtaccccanatactacacaagactccgtagaacgggcattcactatctanagaagacaattccaaggaacactattgtaactcttaacaaatagaaactaaccgtaggaacgaacggaccggaaggaccacgggacctaagtggttaattacgtggtgggtcgggggttacttaacgttttaccgttccgggtaacccccgggttcggggggttaccccggggttaaaccccgttcggggttaccccgtaacccccggttcccctacccccccgttaccccgttaaccccgaaccccggtaaaccccgggg

SEQ ID NO: 418242 - DNA, 595 bp, Homo sapiens
  misc_feature: GZ8MTXP01DV39Q.21.78.H01.1.454.CMB.2.raw
  modified_base (257)..(257): a, c, t, g, unknown or other
  modified_base (567)..(567): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgnaccgtctcgtggttcggggtcagtggcgactacatgagcgtgggtccgcaggctccgagggagggcctggagtggatctcacttatttatagtggtcgtacccacatactacacaagactccggtgaacgggccatcacatctacagaagacaattccaaggaaacactattgtacttctacaaatgaaattaacctggaacgacgccgaaggacacggacctagtgtattacgtggtcggtggggactagttttacgtcggaccccgttgggggcccgggttaaccctgggtacccaacccggttcccncccccaccgtcccgaacccgtaaccggg

SEQ ID NO: 418243 - DNA, 611 bp, Homo sapiens
  misc_feature: GZ8MTXP01COKO5.21.78.H01.1.454.CMB.2.raw
  modified_base (457)..(457): a, c, t, g, unknown or other
  modified_base (486)..(486): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccggaggggaagggccgtgggagtggatctctacttatttagtagtggtacggtaccccacatactacacaacgacctccgtaggaacgggcctatccacatctacaaagaacgaacaaattcccgaaggaaccactattgaatcttaanaaatgaaatacctgagacgccgaggaccncggactatgtattcgtgtggtgggcttacgtttaccgttacggccccgggttcgggggcccggggaaccccttggggccctaacccggtcccctacccccgaccctcccgaacccggtaacccgg

SEQ ID NO: 418244 - DNA, 631 bp, Homo sapiens
  misc_feature: GZ8MTXP01DTSFH.21.78.H01.1.454.CMB.2.raw
  modified_base (485)..(485): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatggagcgtcgggtcccgccaggcctccgaggggaagggccgtagggacgtggatcgtactactttatttagtaggtggtacgtaaccccactatactacacaacgactccggtagaacgggcctattccgaacatctacaagaacgacaattcccaaggaaaccatattgattctaacaaatagaaactaactggaanacgaccgaaggaccacggacctagtagtattacgtggtgtcggggattacgtttacgtaccggtaccccggttgggggcccggggttaacccctgggtacccaacccgttcccacccccacccgtaaccccgaacccgaacccggg

SEQ ID NO: 418245 - DNA, 564 bp, Homo sapiens
  misc_feature: GZ8MTXP01A716L.21.78.H01.1.454.CMB.2.raw
  modified_base (476)..(476): a, c, t, g, unknown or other
  modified_base (485)..(485): a, c, t, g, unknown or other
  modified_base (538)..(538): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtcccgcaggctccgaggggaagggcctggagtggatctcacttatttatagtggtggtaccccacatactacacaagactccgtgaagggccgattccacatctcaagaagacaattccaaggaacactattgatcttacaaatgaaagtaacctgagagcgagacacggccatgtattacgngtgtggggntatttcgttacgccccgttgggggcccggggaaccctgggtccaaccggtccnccccaccctcccgaaccgaacccggg

SEQ ID NO: 418246 - DNA, 600 bp, Homo sapiens
  misc_feature: GZ8MTXP01CZEX0.21.78.H01.1.454.CMB.2.raw
  modified_base (356)..(356): a, c, t, g, unknown or other
  modified_base (440)..(440): a, c, t, g, unknown or other
tcagtcgtcgctcgcacgaccggtgctcgatttagtgtgagtagttgggtttgggggggagaggagcccagcactgggattccgaggtgtttccattcggtgatcagcactgaacacagaggactcaccatggagtttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgcaggctccgaggggaaggcctggagtggatctcacttattatagtggtcgtacccanatactacacaagactccgtagaaacgggcctatcacatctacagaacacaattccgaaggaaacactattgtaacttcttaaanaaatagaactaacgagacgacgacgaagacacgactagttagtatacgtggtgggtggttacttacgttaccgtaccgggacccgggttacgggggcccgggttaccgtcggtaccctaacccgtcccctacccccgaccctaacccgaaccgtaaccgg

SEQ ID NO: 418247 - DNA, 650 bp, Homo sapiens
  misc_feature: GZ8MTXP01A5NDS.21.78.H01.1.454.CMB.2.raw
  modified_base (370)..(370): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcagcatggagttttggctgagctgggttttccttgttgctatttcaaaggtgtccagtgtgaggtgcagttggtggagacgtggaggaggcttgatccagccgtgggggtcctgagactctcctgtgcagtctcgtggggttcgtcaggtggcgactacagtgacgcgtcgggtccgccgaggcctccgagggggacggccgtggaggtggatctactactttatttagtaggtggtcggtaccanatactacaacagctcgtagaacgggccgtatcacatctacaagaagactaacttacccgaaggaacacgtattagtaactacttaacaaagttacggaaacttaaaccgtgaacgacgaccgaggaccacggcctaagtcgttatacgtggtggttcggggtacttacgttttaaccgtccgggttaccccgggttcgggggttaccccggggtaaccccgttcgggtcccgtaccccggttccccttacccccgtaaccccgttccccgaaaccccggg

SEQ ID NO: 418248 - DNA, 551 bp, Homo sapiens
  misc_feature: GZ8MTXP01BJBCW.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgaggggaagggcctggagtggatctctacttattatagtggtggtaccccacatactacacaagactccgtgaagggccatcacatctcagaagacaattccaaggaacacattgatcttacaaatgaaatacctgagagccgaggacacggaccatgtaattactgtggtggggctatttcgtcgaccccgttggggcccgggacctggtccaaccgtcctccccaccctccaaccgaaccggg

SEQ ID NO: 418249 - DNA, 594 bp, Homo sapiens
  misc_feature: GZ8MTXP01DJ8WE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcttgtgcagtctcgtgggttcgtcaggtggcgactacatgagcgtgggtccgcgaggctccgagggagggccgtggagtggatctcactttattatagtggtcgtacccacatactacacaagactcgagacgggcctatcactatctacagaagacaattccgaagaaacactattagtattacttacaaaatagaaactaacctgaagacgaccggaaggacacggaccatgttatactggtggtcggggctacgtttaccgttcggccccggttacgggggcccgggaacccgttgggaccctcccggtccctcccccaccctcccgaacccggaacccggg

SEQ ID NO: 418250 - DNA, 649 bp, Homo sapiens
  misc_feature: GZ8MTXP01EDHF1.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgacgaccctcctgtgcagtctcgtgggttcgtcagtggcactacatgagctgggtccgccgaggctccgaggggaacggcctggagtggatctctactttatttatagtggtggtaccacatactacacgagaacctccgtggaacggggccgtaattccaacctatctacgaagaaacgactaaacttccaaggaaacaacgtatttagtaacttacttacaaaattagaaacttaaccgtgaagacgaccggaagaccgaccggaccaatgttaattacgtgtggtggggtcttagtttaccgttcggaccccgggttcgggggccccggggttacccttcgggtcccgtaccccgttcccgttccccccgacccgttaccccgaacccgaaccggggtaacccccg

SEQ ID NO: 418251 - DNA, 684 bp, Homo sapiens
  misc_feature: GZ8MTXP01EYETV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgtcagtggcgactacatgagcgtgggtcccgcaggctccgagggaacgggcctggagtggatcgtactactttatttagagtggtacgtaaccccactatacctaacacaaacgacctccggtagaaacggggccctattccaacatctacaaagaaacgaacaacttaccaaaggtaaaccagtattagtaactcttaaacaaaattagaaaactaaccgtaggaacgacgacccgaaggaccaaccgggacctaagtgttaaattcgtggtgggtcggggttacttaagttttaaccgtccggaacccccgggttggggggaccccggggttaaccccgttggggtcccctaaccccggttccctaccccccgttaccccgttaaccccgaaccccggtaaaccccgggg

SEQ ID NO: 418252 - DNA, 631 bp, Homo sapiens
  misc_feature: GZ8MTXP01BEX0V.21.78.H01.1.454.CMB.2.raw
  modified_base (404)..(404): a, c, t, g, unknown or other
  modified_base (406)..(406): a, c, t, g, unknown or other
  modified_base (430)..(430): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcagtggcgactacatgagcgtcgggtcccgccgaggcctccgagggaagggcctgggagtggatctactactttatttatagtggtacgtaccccactatactacacaagactcgagaagggccatcacatcnanagacatcagacactatagatctanaaatcgaaataactgagacgacgaaggaccacggacctagttacgtaattaccgtggtaacggtcggggttcttaacgttttaccgtaccggaccccgggttcggggggaccccggggttaaaccccgttcgggtaccccgtaaccccggttccccgtaccccccgttaaccccgtccccgttaaccggtaaaccccgggg

SEQ ID NO: 418253 - DNA, 626 bp, Homo sapiens
  misc_feature: GZ8MTXP01ADFAW.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtccgcaggctccgaggggaagggcctggagtgggatctcgtaactttatttataggtggtacgtaccccatatactacacaacgactccgtgaaacggggcctattccacatctacaagaagacaacttaccgaagaacactattagtatacttaacaaatgaaactaacctgagacgaccgagacgacggacctagtcgttattacgtggtggtggggttactacgtttacgtccggtaaccccggttgggggccccgggttaacccgtcggtccctaaccccggtcccctacccccgacccctaacccgaacccggtaaccccggg

SEQ ID NO: 418254 - DNA, 610 bp, Homo sapiens
  misc_feature: GZ8MTXP01DQXMU.21.78.H01.1.454.CMB.2.raw
  modified_base (361)..(361): a, c, t, g, unknown or other
  modified_base (496)..(496): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcagtggcgactacatgagcgtcgggtcccgcaggctccgagggagggcctggagtggatctcactttatttatagtggtcgtacccanatactacacaagactcgtagaacgggcctattccactatctacaagaagacaacttccgaaaggaaacactaatttgtaattcttaactaaaatcgaaacttaaccgtgaagacgaccgaaggacacggacagtntattactgtggtcgggttctaacgtttaccgtcggtaccccggttgggggcccggggttaaccctgggtcccaacccgttccctacccccgaccctccccgaacgtaacccggg

SEQ ID NO: 418255 - DNA, 584 bp, Homo sapiens
  misc_feature: GZ8MTXP01EBZL1.21.78.H01.1.454.CMB.2.raw
  modified_base (361)..(361): a, c, t, g, unknown or other
  modified_base (494)..(494): a, c, t, g, unknown or other
  modified_base (560)..(560): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccgtgggggtccctgagactctcctgtgcagtctcgtgggttcgtcagtggcgactacatgagcgtgggtccgcgaggctccgagggaacggcctggagtggatctctacttatttatagtggtcgtacccanatactacacaagacctcggtagaaacggggcctatacaccattcacaagaagacaattccaagaaccatattagtatcttaacaaatagaaactaacctagaacgacgacgaggacacggaccatgtattcgngtggtgggctacgtttcgtcggtacccgttcgggggcccggttaacctgggtacccaaccgtcccnccccacctcccgaaccgaacccgg

SEQ ID NO: 418256 - DNA, 607 bp, Homo sapiens
  misc_feature: GZ8MTXP01EY1C9.21.78.H01.1.454.CMB.2.raw
  modified_base (495)..(495): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagcgtgggtccgccaggctccgagggagggcctggagtggatctctactttatttataggtggtacggtaccccatatactacacaagactccggtagaacggggcctattccgaccatcctacaagaacgacaattcccaaggtaaaccactattgtaatcttaacaaatgaaataacctggaagacgaccgagacacggcagtntattacgtggtggtggggttctacgtttacgtcggaccccggttgggggcccgggttaacccgtggtcccaaccccggtcctcccccgaccctccccgaacgtaaccccggg

SEQ ID NO: 418257 - DNA, 720 bp, Homo sapiens
  misc_feature: GZ8MTXP01C80NX.21.78.H01.1.454.CMB.2.raw
  modified_base (680)..(680): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgtcagtggcgactacatgagcgtcgggtcccgccgaggcctaccggaaggggaacggggcccgtagggacggtgggacttcgttactaacgttttatttaagtaggttggtacggttaaccccactaatactaacacaaacgacctcggaggaaacgggcccgtattccaccacgtactacaagaaagtaacaacttaccgaaaggaactacgtattagtaattactaacaaaatagtaaacgtaaacctaggaacgacggaccgaaggaccgaacgggacctaagtacggtttaacttacggttggttgggttacggggactttaacgttttaccgttacccgggaccccgggttaccggggggacccgggggttaaccccttgggggtacccctaacccggttccccnccccccgttaaccccttccccgaaacccgtaaccccgggg

SEQ ID NO: 418258 - DNA, 678 bp, Homo sapiens
  misc_feature: GZ8MTXP01BJ8EK.21.78.H01.1.454.CMB.2.raw
  modified_base (478)..(478): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcaggtggcgactacatgagtcgtcgggtcccgccgaggcctccggaagggaacggggcctggagtggactctactactttatttagtaggtggtacggtaccccactatactacacaacgtacctccgtagaacgggcgtacttccacatctacaagtaacgactaacgttaccgaaggaaaccaattagttcgtaataccttanaaaagtcgtaaataaccgtaggacgaacgaccggacggaccacggtacctagttgttaacttacgtgggtaaggtcggggttacttacgtttaccgtaccgggtaccccgggttcggggggcccggggttaaccccgtcgggtacccgtaaccccgttccccgacccccgaccccttaacccgaaccccgtaaccccggg

SEQ ID NO: 418259 - DNA, 661 bp, Homo sapiens
  misc_feature: GZ8MTXP01DSD83.21.78.H01.1.454.CMB.2.raw
  modified_base (353)..(353): a, c, t, g, unknown or other
  modified_base (445)..(445): a, c, t, g, unknown or other
tcagtcgtcgctcgcacgaccggtgctcgatttagtgtgagtagtttgggtttgggggggagaggtgcccagcactgggattccgaggtgtttccattcggtgatcagcactgaacacagaggactcaccatggagttttggctgagctgggtttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgcaggctcgagggaggctggagtggatctctacttattatagtggtcgtacccanatactacacaagactcggtagaacggggcatacactatctacaaggaaacacaaattccgaaaggtaacactatttagaacttaccttaaanaaagtacgtaaactaacgtaggaacgaacggaccggaacggacgacggactagttagttacgttacgtgggtaagggtcgggttaccttaacgtttacccggtcccggggtaaccccggggttccggggggttaccccggggttaccccgttcgggtacccctccccggttcccctaccccccgttacccgtaaccccgaaacccggtaacccggg

SEQ ID NO: 418260 - DNA, 671 bp, Homo sapiens
  misc_feature: GZ8MTXP01BVXD6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtgggaggaggcttgatccagccgtgggggtccctgagactctcctgtgcagtctcgtgggttcgtcaggtggcgactacatgagcgtcgggtcccgccgaggcctccgaaggggaacgggccgtgggaggtggatccgtactacgtttatttagtaggtggtacggtaccccactatactacacaaagacctccggtaggaacgggcctattccaccatctacaagaaacgacaacttaccaaggaaaccactattgtaactctaacaaatagaaactaacgtggaagacgccgaagaccacggacctagttgtaacgttacgtgggtggtcggggacttaacgttttaccgtccgggtaacccccgggttcggggggaccccggggttaaccccgtcgggtaccccgtaacccgttcccccgtacccccgaccccgttaacccgaacccggtaaccccggg

SEQ ID NO: 418261 - DNA, 591 bp, Homo sapiens
  misc_feature: GZ8MTXP01BDB4N.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaaggcctggagtggatcgtcacttatttatagtggtggtaccccacatactacacaagactcgtgaacggggccatcacatctcagaagacaattccaggaacactattgtatctacaaatgaataactgagagccgagacacggccatcgtattactggtgtggggctagtttacgtcggtaaccccggttcgggggcccggggttaaccccgttgggtacccgtaaccccggttcccgaccccccacccgttccccgaacccggtaaccccgggg

SEQ ID NO: 418262 - DNA, 561 bp, Homo sapiens
  misc_feature: GZ8MTXP01EJO7H.21.78.H01.1.454.CMB.2.raw
  modified_base (296)..(296): a, c, t, g, unknown or other
  modified_base (328)..(328): a, c, t, g, unknown or other
  modified_base (535)..(535): a, c, t, g, unknown or other
tcagtcgtcgctcgcacgaccggtgctcgattagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccncaggctccgagggagggcctggagtggatctnactttatttatagtggtggtaccccacatactacacaagactccgtgaaaggggccattcaccatctacagaagacaattccaaggaaacacattgatcttacaaatgaaataactgagagccgaggacacggcatgtattactgtaagtggggctagtttcgtcgccccgttgggggcccgggaaccctgggtaccaaccggtccncccccacctcccgaaccgaacccggg

SEQ ID NO: 418263 - DNA, 595 bp, Homo sapiens
  misc_feature: GZ8MTXP01C7HGB.21.78.H01.1.454.CMB.2.raw
  modified_base (341)..(341): a, c, t, g, unknown or other
  modified_base (426)..(426): a, c, t, g, unknown or other
  modified_base (436)..(436): a, c, t, g, unknown or other
  modified_base (442)..(442): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactgggaggaggcttgatccagccgtggggggtccctgagactctcctgtgcagtctcgtgggtcgtcaggtggcgactacatgagcgtgggtccgcaggctcgagggaggcctggagtggatctcacttattanagtggtcgtacccacatactacacaagactccgtagaagggccgattcacctatctcaagaagacaatacaaggaacacagttanattcttaaanaaatanaaacgtacgtagacgacgacgaagacgacgactagtgtaatcgtggtggtcgggttacttacgttacgtaccggtacccggttcgggggcccgggttaacccgttcggtaccgtaacccgtccctaccccgaccctcccgaacccgtaaccgg

SEQ ID NO: 418264 - DNA, 706 bp, Homo sapiens
  misc_feature: GZ8MTXP01DZL7M.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtgggaggaggcttgactccagccgtgggggtcctgagactctctgtgcagtctcgtgggttcgtcaggtggcgactacagtgagcgtcgggtccgcgaggcctccggaagggaacgggccgtggagtggactcgtactactttatttagtagtggtacgtaccccataatactacacaaacgactccggtagaacgggccgtattccaacctatctacaaagtaaacgaactaacttaccgaaaggtaaacctactaatttagtaacttaccttaactaaaattacgtaaaacttaaacccgtggaaacgaacggacccggaaggaaccgaccggtaacctagtagttaacttaccgtgggtaacgggtcgggttacttaacgttttccgtaccggtaccccgggttacgggggccccgggttaaaccccgtcgggtacccctaacccggttccccacccccgttacccctaacccgaacccggtaaccccggg

SEQ ID NO: 418265 - DNA, 551 bp, Homo sapiens
  misc_feature: GZ8MTXP01AFWVT.21.78.H01.1.454.CMB.2.raw
  modified_base (391)..(391): a, c, t, g, unknown or other
  modified_base (396)..(396): a, c, t, g, unknown or other
  modified_base (471)..(471): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctcgagggaggcctggagtggatctcacttattatgtggtggtacccacatactacacaagactcgtgaacgggcacttcacatctnagaanacaattccaagaacactattgattcttacaaatgaaataactgaagagccgaggacacggcatgtatactgtggngggactatttcgtcgaccccggttgggggcccgggaaccctgggtcccaaccgtcctccccacctccgaaccgtaaccgg

SEQ ID NO: 418266 - DNA, 612 bp, Homo sapiens
  misc_feature: GZ8MTXP01DTJPS.21.78.H01.1.454.CMB.2.raw
  modified_base (360)..(360): a, c, t, g, unknown or other
  modified_base (448)..(448): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgcaggctccgagggagggcctggagtggatctacactttatttatagtggtcgtaccccanatactacacaagactccggtagaacggggccattccacatctacagaaagacaattccaaaggaaacactatttatattaccttaaanaaatagtaaactaacgtaggaagacggaccgaagacgacggactagtagttatacgtggtggtgggttacttacgtttacgtccggtccccgggttcgggggcccgggttacccgtcggtacccgtcccgtccctaccccaccctaacccgaacccgtaaccgg

SEQ ID NO: 418267 - DNA, 607 bp, Homo sapiens
  misc_feature: GZ8MTXP01AM43T.21.78.H01.1.454.CMB.2.raw
  modified_base (368)..(368): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtcccgccaggcctaccgaggggaagggcctgggagtgggatctcactttatttagtagtggtcgtaccccanatactacacaagactcgtagacgggccattcacatctacagaagacaatccaaggaacacgattgtatcttacaaatagaactaacgtgagacgccgaggacgacggcagtgtattacgtggtggtggggttctaacgttttacgtaccggtaccccgttcgggggcccggggttacccgtcggggtcccaacccgggttccctaccccccgaccccttcccgaacccgaaccccgggg

SEQ ID NO: 418268 - DNA, 678 bp, Homo sapiens
  misc_feature: GZ8MTXP01CTGG4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgaggccgtcggggggtccctgagactctcctgtgcagtctcgtgggttcgtcgaggtggcgactacatggagtcgtcgggtcccgccagggccgtccggaagggggaacgggccgtagggaggtggatcctactactttatttataggtggtacgtaccccactatactacacgaacgacgtccgaggaacgggccgtatacactactctacaagaaacgacaattacccgaaggaaactactaattgtaacttcttaacaaatacgaaactaaacctggaacgacgaccggaacgacgacggtaccagttacgttaattacgtggtaaggtcggggttacttacgtttacgtaccggtaccccgggttcgggggccccgggttaacccgtcgggtaccccgtaacccggtcccctaccccgaccccgtaacccgaaccccggtaacccgg

SEQ ID NO: 418269 - DNA, 579 bp, Homo sapiens
  misc_feature: GZ8MTXP01BNHZ5.21.78.H01.1.454.CMB.2.raw
  modified_base (553)..(553): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtcccgcaggctccgaggggaagggcctgggagtgggatctctactttatttatagtggtggtaccccacatactacacaagactccggtgaacgggccgattccaccatcctcaagaagactaattaccaggaaacactattgtatctacaaatgaaataacctgagagccgagacgacggcatgtattactggtgtgggctacgtttcgtcggtacccgttgggggcccgggaacccgtggtcccaaccggttcccnccccaccctcccgaaccgaacccggg

SEQ ID NO: 418270 - DNA, 765 bp, Homo sapiens
  misc_feature: GZ8MTXP01C702B.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtcgggtccgcaggctccgagggaaggcctggagtggatctcactttatttatagtggtacgtaccccacatactacacaaacgacctccggtagaacgggaccgattaccgaccatcctacaagaaacgaactaaacttccgaaagggaaacctacgtaatttagtaacttaccttaactaaaaattcggtaaaacttaaaccccgtaggaaacggaccgggaacccggaaagggaaccccgaacggggtacccctaagttacggttaaacttaaccggttgggttcggggttacggggggttacctttaaacgttttacccggtttacccgggtaacccccccggggtttacggggggggacccccgggggttaaaccccgtttcgggggttaccccctaacccccgggtttccccgtaccccccccttaaccccccgttaaccccgttaaccccgggtaaacccccggggg

SEQ ID NO: 418271 - DNA, 641 bp, Homo sapiens
  misc_feature: GZ8MTXP01DM838.21.78.H01.1.454.CMB.2.raw
  modified_base (459)..(459): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctctgtgcagtctcgtgggttcgtcgagtggcgactacatgagcgtcgggtcccgcgaggcctccggaggggaacgggccgtagggagtggatcttactactttatttagtaggtggtcgtacccactatactacacaacgactcgtagaacgggcctatcacatctacaagaagacaattccgaaggaaactactattagtaataccttanaaaattcgaaactaaaccgtgaacgacgaccggaaggaccacggacctagttagttaattacgtggtcgggtggggttacttaacgttttacgtccggaccccgggttcggggggccccggttaaccctgggtaccctaacccggttcccacccccgaccgtaacccgaaccgtaacccggg

SEQ ID NO: 418272 - DNA, 705 bp, Homo sapiens
  misc_feature: GZ8MTXP01APD2F.21.78.H01.1.454.CMB.2.raw
  modified_base (448)..(448): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctctgtgctagtctcgtgggttctcaggtggcgactacatggagcgtcgggtccgccgaggcctaccgaggggaacgggcctaggggacgtggatcgtctaacgtttatttagtaggtggtacggttaccccactaatacctacacgtaaacgaccttcccggtagaaacggggcctacttccacattcctacaaggaanactaacttaccgaaggaacaactattgtaactcttaactaaatacgaaacttaaccaggacgaacggccggaacggaaccgaccgggtaccctagtacgttaacttaccgtggtggttacggggcttaacgttttaccgttccggtaaccccggggttcgggggttccccggggttaaaccccgttcggggtacccctaaccccgggttcccctaccccccggttaccccttccccgaaaccccgtaaccccggggg

SEQ ID NO: 418273 - DNA, 758 bp, Homo sapiens
  misc_feature: GZ8MTXP01AN3B9.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgaggggaagggactgggagtggatctctactttatttagtagtggtcggtaccccacaatactaacacaagacctccggtaggaaacggggcccgtaacttccgaccaattccctacgaaaggaaacggaacctaaacgtttaccccgaaaggaaaaccctaacgtaagtttacggtaacttacctttaaccaaaaattacggtaaaaacgttaaacccgtagggtaaacggaacgggacccggaaacggggaaaccctaaccggggaccctaagttacggttaattaaccgtgggttaaggtcgggggttacttacgtttaaccgttcgggtaacccccgggttcggggggacccccggggttaaacccgtcggggttaccccgtaaccccggttccccgtacccccccgttaccccgttaacccccgaacccgggtaaaccccggggg

SEQ ID NO: 418274 - DNA, 679 bp, Homo sapiens
  misc_feature: GZ8MTXP01CW1OA.21.78.H01.1.454.CMB.2.raw
  modified_base (372)..(372): a, c, t, g, unknown or other
  modified_base (424)..(424): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtccgcaggcctccgaggggaacgggcctgggagtggatcctactactttatttagtagtggtacgtaccccanatactacacaagacctccggtagaaacgggccattccactatctacaagaanacgtaattacccgaaggaaacacgtattagtaacttacttaacaaatagaaacgtaaaccgtagaacgacgaccgaaggaccgacggacctagttagtacttacgtgggttcggtagggggttacttacgtttaccgttaccgggtaccccgggttacggggggttccccggggttaaacccgttccgggaaccccgtccccgggttcccctaccccccggaccccgtaaccccgttaacccggtaaccccgggg

SEQ ID NO: 418275 - DNA, 697 bp, Homo sapiens
  misc_feature: GZ8MTXP01BPIEA.21.78.H01.1.454.CMB.2.raw
  modified_base (370)..(370): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgacgcgtcgggtcccgcgaggcctccgaggggaacgggcctgggagtggatctctactttattagtagtggtgtaccccanatactacacaagacctcggtgaaacgggccacttcgacatctacagtaacgactaacttaccaaggtaaacactattagttattacttaacaaaatagtaaacgtaaaccgttaggaacgaacggaccggaacggaaccgaccggacctagttacgttagtttaaccgtggttaacggggttggggactttagtttaaccggtccggtaacccccgggttcggggggacccccgggggttaaacccgttccgggggttacccaaccccggtttaccccgtacccccccgttaaccccgttaaccccgaacccgggtaaaccccgggg

SEQ ID NO: 418276 - DNA, 717 bp, Homo sapiens
  misc_feature: GZ8MTXP01BI5B3.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgctatttacaaaaggtgtccagtgtgaggtgcgagttggtggagacgtggaggaggcttgatccgagccgtgggggtcctgagactctctgtgcagtctcgtggttcgcagtggcgactacagtgagcgtcgggcccgccgaggccgtaccggaagggaacggccgtaggaggtggtactctacgtactttagtttagtaggtcggtacgtaccccaagtactacacacgaagacctccgaggaacgggctactaccactatctacaagtaagaactacttacccgaaagaacctactaattagtaacttacttaaacaaagttacgtaaaacgtaaccgtaggaaacgaccggaaccggaacggaacccgaaccggacctaagttagtttaacgtaccgttgggttaacgggtcgggttaaccttacggtttttaccggtacccggtacccccggggttggggggttacccccgggttaacccgttcgggtacccctaacccggtcccccttacccccgaccccgttaacccgaaccccggtaaccccggg

SEQ ID NO: 418277 - DNA, 581 bp, Homo sapiens
  misc_feature: GZ8MTXP01AQK7I.21.78.H01.1.454.CMB.2.raw
  modified_base (485)..(485): a, c, t, g, unknown or other
  modified_base (490)..(490): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgcgaggctccgaggggaacgggcctggagtggatctctactttatttatagtggtgtaccccacatactacacaagactcgtgaaacgggccgattcacatctcaagaagacaattcccaaggaaacactattgtaatcttacaaatgaaactaactgagacgcgagacacggccatgtatacgnggtgngggctattcgtacgcccggttcgggggcccgggttaaccctgggtaccctaacccggtccctccccaacccgtcccgaaccgtaacccggg

SEQ ID NO: 418278 - DNA, 665 bp, Homo sapiens
  misc_feature: GZ8MTXP01A8YES.21.78.H01.1.454.CMB.2.raw
  modified_base (301)..(301): a, c, t, g, unknown or other
  modified_base (362)..(362): a, c, t, g, unknown or other
  modified_base (516)..(516): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtccnccgaggctccgagggagggcctggagtggatctctactttattatagtggtcgtaccccanatactacacaagacctcggtaggaacgggccgattcacatcctacaagtaagaacaattacccaagggaaacactattagtacttacttacaaatagtaaacgtaacctggaagacgacccggaagaccgacggccaagttggtaactttacgngggttcgggtggggttaccttacgttttaaccgtccgggacccccgggttacggggggttccccggggttaaaccccgttcgggtcccctaaccccgggtccccttaccccccttacccccgtcccgttaaaccccggtaaccccgggg

SEQ ID NO: 418279 - DNA, 799 bp, Homo sapiens
  misc_feature: GZ8MTXP01AUYIZ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagtttggctgagcgttgggttttccttgttgcttatttacaaaaggtgtccagtgtgaggtgctaggttggtggagacgtgggaggaggtcttgactccgaggccggtcggggggtccctggacgtacctcctccgtgtcgctagtctcgtgggttcgtcgaggtggcgactacagtgagcgtcgggtcccgccgtaggcctaccggaggggaacgggcctggggagtggattcctctaactttagtttacgttaggtacgggttcggtaaacccctactaacttaacctaacgaaccgaaacggtaacccgttcccgggtaaagggaaacccgggggtacccttaactttacccgaacctactttacccgtaaacgaaacggtaaacgaacttaaacgttacccgaaaggtaaaaccctacgttaatttacgttaacttacttaaactaaaagtacgtaaaacgttaaccgtaaggaacgaacggaccggaacgaaccgtacggtacccgttaatacgttacgttaacgtgggttaagggtcgggttacttacgtttaacccggtccgggtaaccccgggttcggggggttaccccggttaccggttccggtccgtaaccccgttcccctaccccgaccccgtaacccgaacccggtaacccgg

SEQ ID NO: 418280 - DNA, 548 bp, Homo sapiens
  misc_feature: GZ8MTXP01BLSZY.21.78.H01.1.454.CMB.2.raw
  modified_base (426)..(426): a, c, t, g, unknown or other
  modified_base (432)..(432): a, c, t, g, unknown or other
  modified_base (447)..(447): a, c, t, g, unknown or other
  modified_base (470)..(470): a, c, t, g, unknown or other
  modified_base (528)..(528): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttctgtgctattcaaaggtgtcagtgtgaggtgcagttggtggagactggaggaggcttgatccagccgtgggggtccctgagactctcctgtgcagtctcgtgggttcgtcagtggcgactacatgagcgtcggggtcccgccaggcctccgaggggaagggcctgggagtgggatcgtctactttattatagtggtggtaccccacatactacacaagactcgtgaaacgggccattcaccatcacagaagacaattccaagaaacatattnatctanaaatgaaatactganagccgagacacggcatgtattgngtgtgggctagttcgtcgacccgttgggggcccgggaacctgggccaaccgttccccnccccaccctccgaacgaacg

SEQ ID NO: 418281 - DNA, 725 bp, Homo sapiens
  misc_feature: GZ8MTXP01EVJ1J.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtcttcgtgggttcgtcaggtggcgactacagtgagcgtcgggtcccgccgaggcctccgaggggaaggccgtggagtggatctctactttatttagtaggtggtacggtaccccactaatacgtacacaacgacctccggtaggaaacgggccgtacttaccaacctatacctacgaaagtaaacgaactaaacttaccgaagggtaaaccacttaattagttaacttacttaacaaaatacgaaaacttaacctggaaacgacggaccggaacggaccgaccgggacctaagttcgttaactttacgtgggtgggttacgggggttacttaaacgttttaccggttcccggtaacccccgggtttacgggggggccccggggttaaaccccgttcggggtaccccgtaaccccggtcccccttaccccccgaccccgttaaccccgaaccccggtaaaccccgggg

SEQ ID NO: 418282 - DNA, 605 bp, Homo sapiens
  misc_feature: GZ8MTXP01DI31W.21.78.H01.1.454.CMB.2.raw
  modified_base (299)..(299): a, c, t, g, unknown or other
  modified_base (338)..(338): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtacagtgtgaggtgcagttggtggagactgggaggaggcttgatccagccgtggggggtccctgagactctcctgtgcagtctcgtgggttcgtcagtggcgactacatgagctgggtccncgaggcctccgaggggaagggcctgggagtggatcgttnactttatttataggtggtcggtaccccacatactacacaagactccggtagaaacgggccgtaattccgacccatcctacaagaagactaacttacccaaggaaacactagttagtattacttacaaatcgaaattaaacctgaaagacgacccggaggaccacgggaccagttgtaattactggtggtggggctattacgttgccccgttggggccgggaacctcggtacaacccgtcctccccaccctccgaaccgtaacccggg

SEQ ID NO: 418283 - DNA, 694 bp, Homo sapiens
  misc_feature: GZ8MTXP01D8W34.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgtagttggtggagactggaggaggcttgatccgagccgtggggggtccctgagactctcctgtgcagtctcgttgggttcgtcaggtggcgactacatgagcgtcggggtcccgccgaggcctaccggagggggaacgggccgtggggacgtggacttcgtctaactttatttagttaggtggtacggtaaccacgtactaactaacacgacgtaacctacccggtggaaacgggcccgtaattaccacctatcctacaaaggaacaactaacttccgaaaggaaactactatttagtactacttaacaaaattagaaacttaaccggtgaaggacgaccggaagaccgacggtccaagttcgttaattacgtgggttgggtaacgggctttagttttaaccgttccgggaaccccgggttggggggaccccgggttaacccttgggtccccacccggttcccctacccccgaccttacccgtaacccgaaccggggtcccc

SEQ ID NO: 418284 - DNA, 623 bp, Homo sapiens
  misc_feature: GZ8MTXP01C0K3I.21.78.H01.1.454.CMB.2.raw
  modified_base (371)..(371): a, c, t, g, unknown or other
  modified_base (464)..(464): a, c, t, g, unknown or other
  modified_base (467)..(467): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgaggccgtggggggtccctgagactctcctgtgcagtctcgtgggttcgtcaggtggcgactacagtgagcgtgggtcccgccgaggcctccgaggggaagggccgtgggagtggatctcactttattatagtggtggtaccccanatactacacaagactccgtaggaacggccgtatcacatctacagaacacaattccaaggaacactattgtattctacaaatgaattaaaccgnganacggaccgaacggacacggaccagtagttatacgtggtggtcggggcttaagtttaccgttcggacccccggttaggggggcccccggttaaacccgtccgggtacccgaaccccgtttcccgaccccttaccccctccgaacccgtaaccccggg

SEQ ID NO: 418285 - DNA, 747 bp, Homo sapiens
  misc_feature: GZ8MTXP01D5XO0.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtcctgacgactctcctgtgcagtctcgtgggttcgtcgaggtggcgactacatgagcgtcgggtccgccgaggcctccggaggggaagggccgtaggagtggatcgtctactttatttataggtggtacgtaccccatataactacacaagactccggtagaacgggccgtatccacctatcctacaagaacgactaaacttaccgaaaggtaaacctaacgtaatttacggtaacttaccttaactaaaaagttacggtaaaacttaaacccgttagggaaacggaacgggtacccggaaacgggtaaccgaaccgggtaaccctaagttgtttaaacttaaccggttgggttaaggggttcgggggttaccttaacggttttaccgttacccgggtaaccccggggttaccggggggccccgggggttaaaccccgttcggggtacccctaaccccggttcccctaccccccgttaccccgtaacccgaaccccggtaaaccccgggg

SEQ ID NO: 418286 - DNA, 644 bp, Homo sapiens
  misc_feature: GZ8MTXP01CND33.21.78.H01.1.454.CMB.2.raw
  modified_base (354)..(354): a, c, t, g, unknown or other
  modified_base (372)..(372): a, c, t, g, unknown or other
  modified_base (483)..(483): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgtgggttcgtcaggtggcgactacatgagcgtgggtccgcaggctcgagggaggcctggagtggatctcacttattatagtggtgtacccanatactacacaagactcgngaaacggccgatccactatctacaagaaacgacaattcccaaggaaacacgtattagtaactctttaacaaaattgaaacttaaccgtagaacgacgaccggaaggaaccncggacctattacgggttaattaacgtggtaacggtcggggacttaacgttttaccgtaccggccccggttacgggggggaccccgggttaaaccccttggggtaccctaaccccggtccctaccccccgacccgtaaccccgttaacccggaaccccgggg

SEQ ID NO: 418287 - DNA, 643 bp, Homo sapiens
  misc_feature: GZ8MTXP01EIHLI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtccgccgaggcctccggaggggaacggggccgtagggagtggatccgttactactttatttataggtggtacggtaccccactatactacacaacgactcggtagaacgggaccacttcacatctacagaagacaatccaaggaacactattgtattctaacaaatgaaataactgaagacgaccgaaggaccacggactatgttattacgtggtaaggtgggacttacgttttacgtccgggtaccccggttacggggggccccgggttaaacccgtcggggtcccctaacccggttcccctaccccccgaccccgttaaccccgaacccggtaaccccgggg

SEQ ID NO: 418288 - DNA, 615 bp, Homo sapiens
  misc_feature: GZ8MTXP01AGMDW.21.78.H01.1.454.CMB.2.raw
  modified_base (384)..(384): a, c, t, g, unknown or other
  modified_base (410)..(410): a, c, t, g, unknown or other
  modified_base (498)..(498): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcaggtggcgactacatgagcgtgggtccgccaggcctccgaggggaacgggcctgggagtggatctcactttatttatagtggtcggtaccccacatactacacaagactccgngaacggggccattcacatcacagaanacattaccgagaacacattgtacttcttaacaaatcgaaactaaccgtggacgacgccggaaggacaccggcctagtgttaacttcgnggttggtggggttcttattttaccgtcgggaacccccgttggggggccccgggttacccgtggggtccctaacccgggttccccacccccgacccgtccaaccccggtaacccgggg

SEQ ID NO: 418289 - DNA, 612 bp, Homo sapiens
  misc_feature: GZ8MTXP01B98ZB.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaaggggcctgggagtggatctcacttatttatagtggtggtaccccacatactacacaagactccgtagaagggccattcaccatctacagaaagacaattccaaggaaacactattgtatcttacaaatagaaataacgtagagacggccgaaggaccgacgggacccattcggtaattcgtgtggtcgggggctacgttttaccgtcggtaacccccgttggggggccccggggttaacccgttcggggtccctaacccgtcccgtccccccttacctaaccccgttaaccgaacccggg

SEQ ID NO: 418290 - DNA, 562 bp, Homo sapiens
  misc_feature: GZ8MTXP01AKAMH.21.78.H01.1.454.CMB.2.raw
  modified_base (367)..(367): a, c, t, g, unknown or other
  modified_base (407)..(407): a, c, t, g, unknown or other
  modified_base (484)..(484): a, c, t, g, unknown or other
  modified_base (532)..(532): a, c, t, g, unknown or other
  modified_base (540)..(540): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtggggggtccctgagactctcctgtgcagtctcgtgggttcgtcagtgcgactacatgagcgtcgggtccgccaggctccgagggacgggcctggagtggatctctactttatttactagtggtacgtaccccanatactacacaagactcgtagaacgggccatccacatctanagaagacaattccaagaacactatgtattcttaacaatagaaactactagagacgccgaagcgaccgacatgtatcnggtgtgggctattcgtcgacccggttggggcccggttacctggtcccnccgtcccncccacctcccgaacgtaaccgg

SEQ ID NO: 418291 - DNA, 671 bp, Homo sapiens
  misc_feature: GZ8MTXP01D6ZUX.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtcccgccgaggctaccggaggggaacgggccccggagtggatctctacttattatagtggtgtaccacatactacacagaacctcgtgacgggccattcaccatctacagaagaactaattccgaaggaaacactattcgtatacttaacaaatagaaactaaccgtagacgaacgacccggaggaccacggcctaagtcgttattacgtggttgggtaacggggtacttacggtttaccgtttccgggaacccccggttcgggggggaaacccccgggggttaacccttcggggtaacccccgtaaccccggttcccccgtaccccccctaccccgttaccccgtaaccccgaaaacccgggggttccccccg

SEQ ID NO: 418292 - DNA, 664 bp, Homo sapiens
  misc_feature: GZ8MTXP01BMLBF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtcgggtcccgccaggcctccggaaggggaaggggtacgtggggagtgggatctctactttatttagtaggtggtacggtaacccccactagtaactacacgaaacgtacctccggtaggaaacgggccctaagttcccaacctactcccttacgaagaaacgtaacaaactttacccgaaaggtaaaccacttaatttacgtaattaccttaacaaattacgaaacttaaccgtagagacgaccggacgacgaccgccatggtacttacgtggtggtgggaccttagtttccgtaccggcccggttcgggggcccgggttaaccctgggtacccctccgtcccctaccccacccctcccgaaccgaacccgg

SEQ ID NO: 418293 - DNA, 695 bp, Homo sapiens
  misc_feature: GZ8MTXP01EPUQ4.21.78.H01.1.454.CMB.2.raw
  modified_base (563)..(563): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgaggtggcgactacatgagcgtcgggtccgcgaggcctccgagggacggccgtggagtggatcgtactactttattagtagtggtcgtaccccacgtatactacacgaacgtacctccggtaggaaacgggccctaacttaccgaacctattacctacgaaacgtaaacggaactaaacgttaccgaaaggaaacctaacgttatttacgtaacttaccttaagaaaattacgaaaactaaccgtaggaacgacggaccgaaggaccgacggacctagtagtacttacgngggttaacggtggggttacttaacgtttcgtaccgggtaccccgggttcgggggaccccgggttaacccgttgggtaccccgtaaccccgtccctaccccccgaccctaacccgttaacccggaaccccggg

SEQ ID NO: 418294 - DNA, 561 bp, Homo sapiens
  misc_feature: GZ8MTXP01AYN4E.21.78.H01.1.454.CMB.2.raw
  modified_base (299)..(299): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccncaggctccgagggagggcctggagtggatctctacttatttatagtggtggtaccccacatactacacaagactccgtgaaacgggccattcacatctcagaagacaattccaggaaacactattgtatcttacaaatagaaataacctgaagacgaccgaggacacggccaatgtattactgtggtgggctagtttacttcgaccccttggcgggccgggaacctggtccacccggtccttccccaacccttccgaacccg

SEQ ID NO: 418295 - DNA, 614 bp, Homo sapiens
  misc_feature: GZ8MTXP01B5KV6.21.78.H01.1.454.CMB.2.raw
  modified_base (301)..(301): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtggggggtccctgagactctcctgtgcagtctcgtgggttcgtcagtggcgactacatgagcgtgggtccncgaggctccgagggaggctggagtggatctcactttatttagtagtggtcgtacccacatactacacaacgactccgtagaacgggcgattcaacatctacagaaacgacaattacccaaggaacactattagtacttacttacaaatagaaactaacctagaagacgaccggaaggacgacggacctatacgttaatacgtggtggtggggcttagtttaccgttcggaccccggttcggggggcccgggttaacccgtgggtaccccaaccgttccctccccccgaccctaacccgaacccgtaacccggg

SEQ ID NO: 418296 - DNA, 729 bp, Homo sapiens
  misc_feature: GZ8MTXP01EKXUS.21.78.H01.1.454.CMB.2.raw
  modified_base (259)..(259): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtggaggaggcttgatccgagccgtgggggtcctgagctctctgtgcngtctcgtggttctcaggtgcgactacagtgagcgtcgggtccgaccgaggccgtaccggaggggaacgggcccgtagggaaggtggtacttccgttactaacgttttagttttagtaggttgggttaccggtaacccccaacgtaactaacctaaccaaccgtaaaccgtaccgttccggtagggaaaccggggtcccgtaacttacccgaaccctattacctacgaaagaaacgtaactaaaccgttaccgaaaggtaaacctaacgttatttacgttaacttaccttaaacaaaagttacgtaaacgttaaccgtaggaacgacggaccggaagaccgaccggtactagttgttacttagtggtggtgggttacttacgtttacgtccggtaccccggttcgggggcccggttaaccgtcggtaccctcccgttcccaccccacccgtaacccgaaccggtaacccgg

SEQ ID NO: 418297 - DNA, 882 bp, Homo sapiens
  misc_feature: GZ8MTXP01CXGSF.21.78.H01.1.454.CMB.2.raw
  modified_base (278)..(278): a, c, t, g, unknown or other
  modified_base (280)..(280): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagacgtgggaggaggcttgatccgaggccgtgggggtccctggagactctcctgtgctagtctcgtggttcncnggtggcgactacagtgacgcgtcgggtcccgcgacggccgtaccggaaggggaaacgggcccgttagggaacggtacgggtacttcgttaccgtaacgttttaatttagttacggttagggttaccggttaaacccccaactaacttaacctaacaaaccgtaaacgtaacccgttcccgggttacgggaaaacgggggtaccccttaaacttacccaaacccctaaatttaccccgtaacgtaaaagggaaaacgtaaaacctaaacgtttaaccccgaaaagggtaaaaacccctaaacgttaactttaaggttaaacttaaccgttaaaccgtaaaaattaacggtaaaaacttaaacccgttaaggggaaacgaacgggaaccccggtaaaggaaacccgaaccgggtaaccctaagtttagttaaccgtttaaacgttggggttaagggtacgggggttactttaaacgttttaccgttaacccgggtacccccggggtttaggggggggaccccgggttaaacccgtttccgggaccctaaccccgggttcccacccccggttaccccttaacccgaaaccccgggtaaccccggg

SEQ ID NO: 418298 - DNA, 694 bp, Homo sapiens
  misc_feature: GZ8MTXP01CU775.21.78.H01.1.454.CMB.2.raw
  modified_base (455)..(455): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaggcctggagtggatctcactttattataggtggtaggtaccccacatactaacacaagacctccggtaggaaacgggcccgattccacctatacctacaagaaacgacaaattccaaggaacaactattagtataccttaanaaaatacgaaacttaaaccgaggtaacgaacggcccgaaaggaccgaaccgggtaccaagttacggttaatttaaccgtgggttcgggtacgggggttacctttaaacgttttccggttaccgggaccccccgggtttacgggggggccccggggttaaaccccgttcgggtaccccgtaaccccggttcccctaccccccgttaacccccttaaccccggaacccgtaaccccggggg

SEQ ID NO: 418299 - DNA, 764 bp, Homo sapiens
  misc_feature: GZ8MTXP01CT309.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacagtgagcgtcgggtcccgccgaggcctaccggaagggggaacggggccgtgggaggtggacttccttactaacttttatttaagtaggttgggttacggtaacccccacaacttactaacaccaaacgacctccggtaggaaacggggtccgtattccaaccactcctacaaagaacgaactaaacttaccgaaggaaacaactatttacgtaacttaccttaaacaaagttagaaaacttaaacccgtaggaaacggaacggacccggaaacgggaaccgaccgggtaccctaagttacggttaactttaaccgttgggttaacgggtcgggggttacttaaacggttttaccgttaccgggtacccccgggttcggggggttaaccccgggggttaaaccccgttcggggtaccccgtaaccccgggttcccctaccccccgttaccccgtaaccccgaacccggtaaaccccgggg

SEQ ID NO: 418300 - DNA, 656 bp, Homo sapiens
  misc_feature: GZ8MTXP01ANS9M.21.78.H01.1.454.CMB.2.raw
  modified_base (302)..(302): a, c, t, g, unknown or other
  modified_base (621)..(621): a, c, t, g, unknown or other
tcagtcgtcgctcgcacgaccggtgctcgatttagtgtgagtagtttgggtttggggggagaggagcccagcactggcattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctggagactctcctgtgcagtctcgtggggttctcagtggcgactacatgagcgtcgggtccncgaggcctaccgagggggaacggccgtggacgtggattctactacttttatttataaggttcgggtacggtaccacataacctacaaactagccttcggaggaaacggggccctaagttccacctatctacgaagaacgaactaacttacccgaacggaacaactacttagtacttacttacaaatacggtaaactaaacctgaacgacgaccgaaggaaccaccggacctagttagtaacttctaaggtggttgggggtaccttagtttaccgtacgttacccggttcggggaccccgggtaaccgttcggtaacccncccggtcccaccccgtaacccgttcccgaaccccg

SEQ ID NO: 418301 - DNA, 592 bp, Homo sapiens
  misc_feature: GZ8MTXP01A6N0A.21.78.H01.1.454.CMB.2.raw
  modified_base (361)..(361): a, c, t, g, unknown or other
tcagtcgtcgctcgcacgaccggtgctcgatttagtgtgagtagtttgggtttgggggggagaggagcccagcactggaattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcgagtggcgactacatgagcgtgggcccgcaggcctccgagggagggcctggagtggatctctacttatttagagtggtcgtaccccanatactacacaagactccggtagaacgggccgattcaccatctcaagaagacaattccaaggaaacactattagtacttacttacaaaattgaaactaccgtaggagacgaccggaaggaccacggacctagtagtatttacgggtggtggggctatttcgtcgaccccggttgggggccccgggttaccgtggtccaacccgtccaccccaccctcccgaacgaacccggg

SEQ ID NO: 418302 - DNA, 692 bp, Homo sapiens
  misc_feature: GZ8MTXP01BAUJ7.21.78.H01.1.454.CMB.2.raw
  modified_base (379)..(379): a, c, t, g, unknown or other
  modified_base (429)..(429): a, c, t, g, unknown or other
  modified_base (463)..(463): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagacgtggaggaggcttgatccgagccgtgggggtccctgagactctcctgtgcagtctcgtgggttcgtcaggtggcgactacatgagcgtgggtcccgccgaggcctccggaaggggacgggccgtgggaggtggattcctactactttatttagtagtggtacgtaccccanatactacacaacgacgtccggtagaacgggccgtattaccaccataccanaagaacactaactaccgaaggaaacacttagttntaattcttaacaaatacgtaaactaaccggtggaacggacgaacccggaaggaccaccggtactattacgtactttacggtggtaagggtggttacctttaagttttcccggtaccggtaccccccggggttggggggttccccgggttaaacccctttcgggggtacccctaaccccgggttcccctaccccccgttaacccccgtcccgaaccccgggaaccccggg

SEQ ID NO: 418303 - DNA, 620 bp, Homo sapiens
  misc_feature: GZ8MTXP01C2V9E.21.78.H01.1.454.CMB.2.raw
  modified_base (470)..(470): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactgggaggaggcttgatccaggccgtgggggtccctgagactctctgtgcagtctcgtgggtcgtcagtggcgactaacatgagcgtgggtccgcaggctaccgaagggaagggcctgggaagtggatcctactaactttatttaagtaggtggtacggtaaccccactaataactaacacgaaagtacctccgtaggaaacgggccgtatcaaccatcacaagaagaactaaagtccaaggaacatattagtaatcttaaanaaatagaaataacgagagacgacgagacacgactatagtattgtggtggtcgggacttacgttaccgtaccggacccgggttcgggggacccggttacccgtggtacccgtcccgtcccctaccccaccctaacccgaaccggtaaccgg

SEQ ID NO: 418304 - DNA, 715 bp, Homo sapiens
  misc_feature: GZ8MTXP01ED0B6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacagtgagcgtcgggtcccgcgaggcctccgagggagggccgtggagtggactcgtctactttatttagtagtggtacgtaccccatatactacacaacgacctcggtagaaacgggccgtacttaccacctattcctacgaagaaacgaactaacgttaccgaaaggtaaacctactaatttacgtaacttacctttaaacaaaattacggtaaaacttaaaccgttaggaacgacggacccggaacgggaaccgaccgggtacctaagttgttaacgtttaaccgtgggttaaggtgggggttacttacgtttttaccgtccgggtaccccgggttcgggggacccccggggttaacccgtccgggttacccgtaaccccgttccccgtaccccccgaccccgttcccgaaccccggtaaccccggg

SEQ ID NO: 418305 - DNA, 886 bp, Homo sapiens
  misc_feature: GZ8MTXP01AI9ZK.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtcgggtcccgccgaggcctccggaagggggaacggggtccgtaggggaggtgggtacttccgttactaactttattttaagtagggttgggttacggtaacccctaactaactaacctaaccaacgtaaacggtaaccctccggtaacgggaaacggggcccgtaacttacccaaccgtaaacttccgtaccgaaaggaaacgtaaaccgtaaactttaccccggaaaaggtaaaacctaaccgttaaagttttacggttaaactttaccctttaaaccgaaaaatttaacgggtaaaacctttaaaacccggttaggggaaaccggtaaccgggaaccccgggaaacgggaaaccccgaaccggggtaccctaaagtttggttaaacgttttaaccgttgggggttaacgggttcggggggttaaacctttaaacggtttttacccggttaaccccgggggtaaccccccggggttacggggggggaccccccgggggttaaccccggttcccggggtaccccgtaacccccggttcccccgtaccccccgttaccccccgttaacccgttaacccccgggtaaaccccgggg

SEQ ID NO: 418306 - DNA, 635 bp, Homo sapiens
  misc_feature: GZ8MTXP01AFXDV.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtggggtcccgccgaggcctccgaggggaagggcctgggagtggatctctactttatttagtaggtggtcggtaccccacatactacacaagacctccgtagaacgggccgattccacatctacaagaaacgacaaacttcccgaaggaaaccactaatttgtaattacctttacaaaattagaaactaacctggaagacgaccggaaggaccaccgggacctagtgtaacttacgtgtgggtggggttactagtttaccgtcggaaccccggttgggggaccccgggttacccgtggtaccctaacccgtcccctacccccaccctcccgaacccgtaacccggg

SEQ ID NO: 418307 - DNA, 767 bp, Homo sapiens
  misc_feature: GZ8MTXP01EJRNS.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctctgtgcagtctcgtggttcgtcagtggcgactacatgagcgtcgggtccgccgaggcctaccggagggaacgggcctaggagtggatcgtactaactttatttagtaggtggtacggtaccccactatactaacacgaaacgaccttccggtagaaacggggtcccgtaatttaccaacctatacctacgaaagaaacgtactaaacgttcccgaaaggaaacctaacgtatttagtaaacttaccttaacaaaaagttcgtaaaacttaaacccgtaggaaacgaacgggacccgaaacgggaccaaccggtacctaattacggtttaattaccgttggttaacggggttaggggttacctttaaacgtttttaccggtacccgggtaaccccccggggttcgggggggttacccccggggaaaccccgttttcgggggtaccccctaaaccccggggttccccctaccccccccggttaaaccccttcccccggaaaaccccgttaaccccggggg

SEQ ID NO: 418308 - DNA, 674 bp, Homo sapiens
  misc_feature: GZ8MTXP01D0V96.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccaggccgtgggggtccctgagactctcctgtgcagtctcgtgggttcgtcgagtggcgactacatgagcgtcggtccgccgaggcctccgagggaacggccgtggagtggatctactactttatttataggtggtcgtaccccactatactacacaacgactcggtagaacgggcctattccacatctacaagaacgactaacttacaaaggaaccaactatttagacttacttaactaaagtagaaacttaacccgtaggaacgaggaccggaacggaacctacgggaccctagttagttaccttaagtggttaagggtcggggttactttaacgttttaccgtaccgggtaaccccgggttcggggggaccccgggttaacccgttcgggtacccctaacccggttcccctacccccgaccccttaacccgaacccggtaaccccgggg

SEQ ID NO: 418309 - DNA, 638 bp, Homo sapiens
  misc_feature: GZ8MTXP01ALI53.21.78.H01.1.454.CMB.2.raw
  modified_base (285)..(285): a, c, t, g, unknown or other
  modified_base (299)..(299): a, c, t, g, unknown or other
  modified_base (502)..(502): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctctgggttcgtcagtggcgactacntgagcgtgggtccncaggcctccgagggagggcctggagtggatctcactttatttatgtggtacgtaccccactatactacacaagactccggtagaacgggccgattccgaccatctacagaaacgactaaacttaccaaggaaacactattagtatcttaacaaatgaaactaactgaagacgaccgagaccacggacctagtagtacttacgnggttaaggtggggttacttagttttacccgtaccggtccccggttcggggggccccgggttaacccgttcgggtacccctaaccccggtttccccgtccccccgaaccccgttcccgaaccccgtaaaccccgggg

SEQ ID NO: 418310 - DNA, 631 bp, Homo sapiens
  misc_feature: GZ8MTXP01D0DKD.21.78.H01.1.454.CMB.2.raw
  modified_base (254)..(254): a, c, t, g, unknown or other
  modified_base (299)..(299): a, c, t, g, unknown or other
  modified_base (472)..(472): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctctgtncagtctcgtgggttctcagtggcgactacatgagcgtcgggtccncgaggcctccgaagggagggcctggagtggatctctactttatttagtagtggtacgtaccccactatactacacaacgacctccggagaacgggccgattccaacctagtctacaagaacacaacttaccaaggaaactactattgtaattctaacaaagtgaaacttaacngaacgacgaccgaggacgacggaccagttagttacttagtcggtgggttggggacttagttttaccgtcggtaccccggttcggggggcccggttaaccccgttggggtacccctaacccgtcccgtaccccgacccctcccgaacccggtaacccggg

SEQ ID NO: 418311 - DNA, 588 bp, Homo sapiens
  misc_feature: GZ8MTXP01CUXEH.21.78.H01.1.454.CMB.2.raw
  modified_base (297)..(297): a, c, t, g, unknown or other
  modified_base (390)..(390): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccncaggctccgagggaaggcctggagtggatcttaactatttagagtggtgtaccacacactacacagaactccgtgaagggccgattcacatcncagaagacaattccaaggaacacattgtatcttacaaatgaaataaccgtagaagagaccgaaggacacggaccagtgtattactgtggtggggtacttattttacgttcgtaccccggtgggggacccggggttaacccttcgggtccaccccgtccctccccaccccttacccgtaacccgaaccgggtaaccccg

SEQ ID NO: 418312 - DNA, 697 bp, Homo sapiens
  misc_feature: GZ8MTXP01B2XD2.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgagtggcgactacatgagcgtcggtccgcgaggctccggagggacgggccgtaggagtggtactctactaactttagtttagtaggtggtacgtaacccccaacgtaataacctaacacgtaaacgaaccgtccggtagggaaacgggcccgtaattacccgaaccctaactcctacgaaagaaacgaactaacgttaccgaaaggtaaaccacttatttacgtaacttacttaaactaaagtacgtaaacttaaaccgtggaaacgacggaccggaagacccgacggtacctaagttcgtaacttacgtggttaacggtcggggttacttaaacgtttccgtaccggccccggttcgggggaccccggaaccgtcggtacctaaccccgtccctccccacccttaaccgaaccggtaaccccgg

SEQ ID NO: 418313 - DNA, 557 bp, Homo sapiens
  misc_feature: GZ8MTXP01CJV5Y.21.78.H01.1.454.CMB.2.raw
  modified_base (359)..(359): a, c, t, g, unknown or other
  modified_base (403)..(403): a, c, t, g, unknown or other
  modified_base (431)..(431): a, c, t, g, unknown or other
  modified_base (469)..(469): a, c, t, g, unknown or other
  modified_base (474)..(474): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtccgcaggctccgagggaaggcctggagtggatctcactttattatagtggtgtaccccanatactacacaagactcgagaacgggcctatcacatctacagaanactaatccaaggaacactattgatctanaaatgaaactactgacgagcgagcacgcatgtatacgngtggngggctagtttacgtcggcccgttggggggcccgttaccgtgggccctaacccggtcctcccccacctcccgaacgtaacccgg

SEQ ID NO: 418314 - DNA, 612 bp, Homo sapiens
  misc_feature: GZ8MTXP01AXUSG.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccgaggcctccgaaggggaagggcccgtggagtgggatctctactttatttataggtggtcgtacccacatactacacaagactccgtagaaggggaccattccacatctacaagaaagacaataccaaggaaacactattgtactacttaacaaatagaaactaacctagaagacggaccgaaggaaccacgggtaccaagtgtaacttacgtgtggtggggactacgtttacgtcgtaaccccggttgggggacccgggttaaccgtggcctaaccggtcccacccccacccgtccaaccgaacccgg

SEQ ID NO: 418315 - DNA, 575 bp, Homo sapiens
  misc_feature: GZ8MTXP01D8M0P.21.78.H01.1.454.CMB.2.raw
  modified_base (422)..(422): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtcccgccgaggcctccgagggggaagggccgtagggaggtgggatctactactttatttagtagtggtacggtacccacatactacacaagactccggtgaacggggccattccacatctcagaanacatcagaacactatgtatactacaaatgaactaactgaagacgacgagacacggacatgtactatgtaagtgggctattcgtcggacccgttgggggcccgggttaccgtggtaccgtcccgtccgtccccacccgtccaaccgtaacccgg

SEQ ID NO: 418316 - DNA, 638 bp, Homo sapiens
  misc_feature: GZ8MTXP01E2GRT.21.78.H01.1.454.CMB.2.raw
  modified_base (373)..(373): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgaggccgtgggggtccctgagactctcctgtgcagtctcgtgggttcgcaggtggcgaactacagtgagcgtcgggtccgccaggcctccgagggaaggcctggagtggatcgtctactttatttagtaggtggtacgtaccccanatactacacaaagacctccgtaggaacgggctatccacactctacaagaacaacaattacccgaaggaaacactattagtattctaacaaatagaaactaactggacgacgacgaacggacacggactagtaggtacttacgtggtgggtcgggttattaactttacgtccggaaccccgggttcgggggaccccggttaaacccggtcggtacccgtaaccccgtcccgtaccccccacccgtccccgaacccgtaaccccggg

SEQ ID NO: 418317 - DNA, 752 bp, Homo sapiens
  misc_feature: GZ8MTXP01AYWTN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtcgggggtcctgagactctcctgtgcagtctcgtgggttcgtcgaggtggcgactacagtggacgcgtcggggtcccgccgaggccgtaccggaagggggaacggggtcccgtggggaggttgggtacttccgtacttaacttttagttttagtagggttggttacggtaaccccaactacttaactaacacgaaacggtacccttccgggtaggaaaccggggaccctatttaccgaacctacgtctaccgaagaaacgaactaaacgttacccgaaaggtaaaccctactaagtttacgtaacttaccttaaactaaaatacgtaaactaaccgtaggaacgacggaccggaacggactacgggacctagttagttacgttacgtggtaagggttcggggacttaacgtttccgtacccgggtaccccggggttcggggggaccccgggttaacccgttcgggtaccctaaccccggtcccctacccccgaccccgtaacccgaacccgtaaccccgggg

SEQ ID NO: 418318 - DNA, 685 bp, Homo sapiens
  misc_feature: GZ8MTXP01DDOP9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgcaggctccgagggagggcctggagtggatctcactttattagtagtggtgtacccactatactacacaagactcgtagaacgggcccgtattccacatcctacaagaaacgacaacgttaccgaaaggaaacactatttacgtaattaccttaacaaaattgtaaaacttaaacccgtaggaacgacggacccggtaaggaccgaaccggacccgtaattacggttaactttacggttggttaacgggttcgggggactttaacggttttaccgtacccggggtaaccccggttcggggggaccccgggggttaaccccgttcgggtacccgtaaccccggttccccacccccgttaccccgtcccgaacccgtaaccccgggg

SEQ ID NO: 418319 - DNA, 690 bp, Homo sapiens
  misc_feature: GZ8MTXP01A50QG.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtccgcgaggctccgagggacggcctggagtggatctctactttattagtagtggtcgtaaccccacgtatactaacacgaaagtacctccggtaggaaacgggcctactttccaaccattcctacaacgaaacgaactaacgttccgaaaggtaaacccattattcgtaacttacttaacaaattacgaaacttaaccgtaggaagacggtaccgaaggaccacggacctagttagtaactttacgtgggtaagggttcggggacttaacgtttaccgttaccgggtacccccggttcgggggggccccgggttaaaccccggttcgggtaccccgtaacccggttcccctaccccccgttaccccgtaaccccgaaccccggtaaaccccgggg

SEQ ID NO: 418320 - DNA, 743 bp, Homo sapiens
  misc_feature: GZ8MTXP01CC4XG.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcaggtggcgactacatggagccgtgggtcccgccgaggcctccgaggggaagggcctggagtggactctactactttatttagtagtggtcggtaaccccacatactacacaacgtacctccggtagaacggggccattaccaaccatcctacaaaggaaactactaaacttcccggaaaggaaactaacctatttaggaaacttacccttaaggaaaattcggtaaaacgttaaaccccgtaggggaaaggaaaccgggccccggaaaaggttacccccgaagggaccctaaggttagttaagttttaacccgggtgggttaacggggtacgggttactttaaaccgtttacccggttcccgggaaccccggggttacggggggacccccgggttaacccgttcgggacccccttaacccggttccccccaccccttacccccgttaacccgaaaccggtaaccccggg

SEQ ID NO: 418321 - DNA, 686 bp, Homo sapiens
  misc_feature: GZ8MTXP01DKQYX.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacagtgagcgtcgggtcccgccgaggcctaccggaagggggaacgggccgtagggagtggattcttactactttatttagtaggtggtacggtaccccactatactacacaacgactccggtaggaacgggacctattccaccatcctacaagaaacgaactaacttacccgaaaggaaacctactattagtaatacttaacaaattacgaaactaaccgtaggaacgacgaccggaaggaccgacggacctagttagtacttacgtggtgggtggggttcttaacgtttaccgtccgggaccccgggttcggggggaccccggggttaacccgttcgggtacccctccccggttcccctacccccgttacccccgtaaccccgaaccccggtaacccggg

SEQ ID NO: 418322 - DNA, 768 bp, Homo sapiens
  misc_feature: GZ8MTXP01CYWDQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccagccgtgggggtcctgagactctcctgtgcagtctcgtggttcgtcgagtggcgactacagtgagcgtcgggtcccgcacggccgtaccggaaggggaacggggcccgtagggaaggtggacttccgttactaacttttatttaagtaggtgggtacgtaacccccagtaaactacctaacaacaaacgtaaccgtccggtagggaaacgggacccgtaattaccaacctactctacgaagaaacgaactaaacgttaccgaaacggaaactaaccttaagtttacgttaaacttaaccttaaactaaaaattaacggtaaaattaaacccgtaggaaacggaaccgggaaccggaaacgggaaccgaccgggtaacctaagttaacgttaagttacgtggtaagggttcggggttactttacgtttaccggttaccggaccccgggttacggggggttaccccgggttaaacccgttcggtaccccgtaaccccggttccccacccccttaccccgtaacccgaaacccggtaaccccgg

SEQ ID NO: 418323 - DNA, 591 bp, Homo sapiens
  misc_feature: GZ8MTXP01E2WC1.21.78.H01.1.454.CMB.2.raw
  modified_base (360)..(360): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccgccaggctccgagggaagggcctggagtggatctcacttatttatagtggtggtaccccanatactacacaagactccgtgaaagggcccgattcacatctcagaagacaattccaggaacactattgtatcttacaaatagaaataactgagagaccgagacacggccatcgtattacgtgtggtggggttactagtttacgttcggaccccgttgggggcccggggaacccgtaaggtcccgaacccggttccctcccccgaccccttccccgaacccgtaaccccgggg

SEQ ID NO: 418324 - DNA, 769 bp, Homo sapiens
  misc_feature: GZ8MTXP01CNTL0.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcgggtcccgccgaggcctaccggaagggggaacggggcccgtaggggaggtgggacttccgttactaacttttatttagtaggtggtcggtaaccccactatactacacgaacgtacctcggtagaaacgggtcccgtacttaccaacctactcctacgaaagaaacgaacctaagttaccccaaagggaaacctaacttagtttacgtaacttacctttaaacaaaagttacgaaaaccttaaacccgtagggaaacgaccggaacccggaaagggaacccaacgggtaccctagtttacgttaacgtttaccgtgggttaacgggttcggggttacctttaaacgttttacccgttacccgggacccccgggttacggggggcccccgggttaaaccccgttgggtaccccctaaccccgtttccccgtacccccccgttaccccgttaaccccgaacccggtaaccccggg

SEQ ID NO: 418325 - DNA, 647 bp, Homo sapiens
  misc_feature: GZ8MTXP01DXF7Y.21.78.H01.1.454.CMB.2.raw
  modified_base (340)..(340): a, c, t, g, unknown or other
  modified_base (353)..(353): a, c, t, g, unknown or other
  modified_base (405)..(405): a, c, t, g, unknown or other
  modified_base (447)..(447): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtcagtgtgaggtgcagttggtggagacgtgggaggaggcttgatccgagccgtggggggtccctgagactctcctgtgcagtctcgtgggttcgtcagtggcgactacatgagcgtgggtccgcaggctccgagggaaggctggagtggatctcattattanagtgtgtacccanatactacacaagactccgtagaacgggcccgtattccaccatctacagaaanactaattacccgaaggaaacactattagtaactaccttaaanaaatagaaacgtaacgtagaacgacggaccggaaggaccgacggactagtagttattacgtggtaagggtacgggttacttacgtttaccgtaccgggtaccccgggttacgggggaccccgggttaaccggttccggtaccccgtaaccccggttcccctacccccgttaaccccgtaaccccgaacccggtaaccggg

SEQ ID NO: 418326 - DNA, 631 bp, Homo sapiens
  misc_feature: GZ8MTXP01AY9FI.21.78.H01.1.454.CMB.2.raw
  modified_base (520)..(520): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccaggctccgaggggaggcctggagtggatctctactttattatagtggtcgtaccccacatactacacaacgacgtccgtaggaacgggcccgtattccgaaccagtacctacaagaaacgaacaacttacccaaggaaacactattagtactcttaacaaatagaaactaaccgtagaacggacgaccgaaggaccaacggaccagtgtaacttacgnggttggtcggggttctacgttttacgtcggaccccggttcggggggacccgggttacccgtgggtcccaacccggtccctcccccgacccgtcccgaaccggtaacccggg

SEQ ID NO: 418327 - DNA, 566 bp, Homo sapiens
  misc_feature: GZ8MTXP01AKKX1.21.78.H01.1.454.CMB.2.raw
  modified_base (361)..(361): a, c, t, g, unknown or other
  modified_base (533)..(533): a, c, t, g, unknown or other
  modified_base (541)..(541): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccgccaggctccgagggaagggcctggagtggatctctactttatttagtagtggtggtaccccanatactacacaagactccgtgaacgggcgattccacatctacagaacgacaattcccaaggaacactattgtatcttacaaatgaaataacctgacgagaccgagacacggaccatgtatacgtgtggtgggctagtttcgtcggacccgttgggggccgggaccctgggccnccggtccnccccaccctccgaaccgtaaccggg

SEQ ID NO: 418328 - DNA, 595 bp, Homo sapiens
  misc_feature: GZ8MTXP01A5P2K.21.78.H01.1.454.CMB.2.raw
  modified_base (503)..(503): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggagcttgatccagccgtgggggtccctgagactctctgtgcagtctgtggttcgcagtgcgactacatgagcgtcgggtcccgccgacggcgtccggaggggaagggccgtagggagtggatctctactttattatagtggtacgtaccccactatactacactaagacctcgtagaacgggccgtactccacatctacaagaaagaacaactaccgaagaacactattagtatacttaacaaatgaaactactagaagacgacgaaggacacggacctatcgtattacgngtggtgggcttagttacgtccggtaccccgttgggggcccggttacccgtcggcctaacccgtccctccccacccctcgaacccgtaaccgg

SEQ ID NO: 418329 - DNA, 625 bp, Homo sapiens
  misc_feature: GZ8MTXP01CMTG1.21.78.H01.1.454.CMB.2.raw
  modified_base (567)..(567): a, c, t, g, unknown or other
  modified_base (573)..(573): a, c, t, g, unknown or other
  modified_base (603)..(603): a, c, t, g, unknown or other
  modified_base (610)..(610): a, c, t, g, unknown or other
  modified_base (614)..(614): a, c, t, g, unknown or other
  modified_base (617)..(617): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggtttttccttgttgctatttcaaaaggtgtccagtgtgaggtgcagttggtggagacgtggaggaggcttgatccagccgtggggtccctgagactctcctgtgcagtctcgttgggttcgtcaggtcggacgactacgatgacgtcgtcgggtcccgccgacggccgtaccggaaggggaacgggccgtagggaggtcggactcttactacgttttagtttagtaggttggtacgtacccccactagtactacacgaacgtaccgtccggagaaccgggccgtattccacctagtcctaacgaagaaacgaactaacgttccgaaaggaaacctactagttacgttactacttaaacgaaatacgtaaacgtaacccgtaggacgacgaccgaggaccacggcatgtatcgtgnggtggnttattcgtcgaccggcgggccgactcgccnccgtccncccnccncaacgccg

SEQ ID NO: 418330 - DNA, 673 bp, Homo sapiens
  misc_feature: GZ8MTXP01CZADP.21.78.H01.1.454.CMB.2.raw
  modified_base (362)..(362): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaggtgtccagtgtgaggtgcagttggtggagacgtgggaggaggcttgatccagccgtgggggcccctgagactctcctgtgcagtctcgtgggttcgtcagtggcgactacatgagcgtgggtcccgcaggcctccgagggaagggccgtggagtggatctcactttatttatagtggtggtaccccanatactacacaagactccggtagaacggggtccgattccacctagtctacaagaagacaattcccgaaaggaactacctattacgtactacttaacaaatgaaacgttaacgtggaacgacggaccggaggaccgacggaccctagttaggttaactccggttggtgggtacggggactttaacgtttaccgttaccgggacccccgggtttacggggggaccccggggttaaaccccgttcgggtaccccgtaacccccgttccccgtaccccccgacccccgttaaccccgaacccggtaaaccccgggg

SEQ ID NO: 418331 - DNA, 825 bp, Homo sapiens
  misc_feature: GZ8MTXP01A17WV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctctgtgctagtctcgtgggttcgtcgaggtggcgactacatggagtccgtcgggtcccgaccgaggccgtaccggaaggggaacggggccgtagggtaggtgggacttccgttactaacgtttatttagtaggttggggttaccggtaaccccaactaactaacctaaccgaaccgtaaacgtaaccgtcccggtacgggaaacggggacccgtaacgttacccgaaccctacgttaccctaacgaaacggaaacggtaaacctaaacgtttaccccgaaagggtaaacctaaaccttagtttaacgtaacttacctttaacaaaagttaacgtaaaacgttaaacccgtaaggaacggaacggtaacccggaacgggaacccgaaccggggtacctaagttacggttaacgtttacgtgggttcggttacgggggttacttaacggtttaccggtacccgggtaacccccgggggttcggggggaccccggggttaaaccccgttcggggtccccgtaaccccggttaccccgtaccccccgttaccccgtaaccccggaacccgtaaaccccgggg

SEQ ID NO: 418332 - DNA, 648 bp, Homo sapiens
  misc_feature: GZ8MTXP01ENB0B.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagtttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccgaggcctaccgaggggaacggggcctgggagtggatccgtctacttatttataggtggtcggtaccccactatactacacaagccgtccgtaggaacgggccgtattccaccattctacaagaacgactaattccaagaaaccagtattgtattctaacaaatcgaaactacctaggaagacggaccgaggaaccgacggacctagtgttaagttactgggtgtggggttacctagttttaccgtccggtaccccgggttacgggggttccccgggttaacccgtcggtacccgtccccggttccccacccccgaccccgttaacccgaaccccggtaacccggg

SEQ ID NO: 418333 - DNA, 680 bp, Homo sapiens
  misc_feature: GZ8MTXP01BS38F.21.78.H01.1.454.CMB.2.raw
  modified_base (366)..(366): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtcgggtcccgccgaggcctccgaggggaagggcctgggagtggatctctactttattatagtggtcgtaccccanatactacacaacgacctcggtgaacgggccgtacttacaccatcctacgaagaaacactaacttccgaaaggaaaccactagtttacgtaattaccttacaaaaagttcgtaaaactaaaccgttggaaacggacgacccggaagggaacccgacggtacctagtagttaacttaccgtggtgggtcgggggttacttacgtttacgttcccgggaaccccgggttcggggggttaccccggggaaccccttcggggttccccaacccggttccccaccccccgttacccgtccccgaacccgtaaccccgggg

SEQ ID NO: 418334 - DNA, 595 bp, Homo sapiens
  misc_feature: GZ8MTXP01DMZ8K.21.78.H01.1.454.CMB.2.raw
  modified_base (256)..(256): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcngtctcgtgggttcgtcaggtggcgactacatgagcgtgggtcccgcaggctccgagggaggcctggagtggatctctactttatttatagtggtcggtacccacatactacacaagactccgtgaaagggccgatcacatctacagaagacaattccaaggaacacattgtatctacaaatagaataactgaagacgaccgaagacgacggaccatgtattacgtgtggtggggctagtttacgtacggaccccgttcgggggttccccggggaacccgttcgggtaccctaacccggtcccctacccccaccccgtaaccccgaaccgtaacccgggg

SEQ ID NO: 418335 - DNA, 728 bp, Homo sapiens
  misc_feature: GZ8MTXP01B8K51.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcgaggtggcgactacatgagcgtgggtcccgccgaggccgtccggaaggggaacgggccgtagggaggtggtattccgtactactttatttagtaggttggtacggtaccccactatactacacgaacgaccgtcggtagaacgggccgtacttaccactactctacaagaaacgaactaacttaccgaaaggtaaactacgtaattacgttaattacttaaactaaaagttacgtaaaccttaaaccgtaggaaacggaaccggacccgggaaacgaaccgaaccgggtaccgtaagttacggtttaaattaccgttgggttaacgggtgggggttaccttaaggttttaccgtacccgggtaccccgggttacggggggaccccgggttaacccgtcgggtcccctaacccggtcccctacccccaccctaaccccgaacccggtaacccggg

SEQ ID NO: 418336 - DNA, 586 bp, Homo sapiens
  misc_feature: GZ8MTXP01A4549.21.78.H01.1.454.CMB.2.raw
  modified_base (333)..(333): a, c, t, g, unknown or other
  modified_base (361)..(361): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcaggtggcgactacatgagcgtgggtccgcgaggctccgagggaagggcctggagtggatctntactttatttatagtggtcgtaccccanatactacacaagactcgtagaacgggcattcacatctcagaagacaatccaggaacacattgatctacaaatgaaatactagagacgcgagacgacgccagtgtatacgtggtaaggtgggacttagtttaccgtcggtaccccggttgggggccccgggttaacccgtcgggtcccaacccggtccctaccccccgttaccctccccgaacccggtaacccggg

SEQ ID NO: 418337 - DNA, 608 bp, Homo sapiens
  misc_feature: GZ8MTXP01EUIPN.21.78.H01.1.454.CMB.2.raw
  modified_base (334)..(334): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtggggggtccctgagactctcctgtgcagtctcgtgggttcgtcaggtggcgactacatgagcgtgggtcccgccaggcctcgaggggaagggcctggagtggntctctactttatttatagtggtgtaccccactatactacacaagactcgtagaagggccattcacatctacagaagacaattccaaggaacacgtattgtacttctacaaagtgaaacttaactagagacgcgaggacacggccatcgtaatacgtgtcggtgggttctacgttttacgtcgggtaccccgttcgggggacccgggggttaaccccgtcgggtacccgtaacccgtcccgtacccccgaccctccccgaacccgtaacccgggg

SEQ ID NO: 418338 - DNA, 754 bp, Homo sapiens
  misc_feature: GZ8MTXP01C6DPL.21.78.H01.1.454.CMB.2.raw
  modified_base (307)..(307): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagtactctcctgtgcagtctcgtgggttcgtcgagtcggcgactacatgagtcgtcgggtcccnccgaggccgtccggaaggggaacggggcccgtaggggagtggacttccttactaacgtttatttagtaggttggtacggtaaccccactaattactacactaaacggaccttccggtaggaaacggggtccctaagttacccaacctatcctacaaaggaaacgaactaagttcccaaaggaaactacgtatttacgtaattacttaacaaaatacgtaaacgttaaaccgtaggaacggaacgacccggaaacggaccgaacgggtaccctaagttcggttaattaccggttggttaagggtcgggggttactttaacgttttacccgggttacggtaacccccggggttacggggggccccgggttaaaccccgttcggggtaaccctccccggttaccccctccccccggaccccgttaacccccgaacccgtaaaccccgggg

SEQ ID NO: 418339 - DNA, 712 bp, Homo sapiens
  misc_feature: GZ8MTXP01BFBFC.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtcgggtccgccgaggcctccgagggaacgggccgtggagtggatctctactttatttagtagtggtacgtacccactatactacacaagacctccgtagaacgggccgattaccacactctacagaaagacaaagttcccaaggaaacctactatttacgtaacttccttaacaaaagttacgaaaacttaacccgttagggaacgaacggacccgaaagggaacccgaccgggaccctaagttcggttaaactttaccggttggtgggttcgggggttacctttaaacgtttttaccgtacccggggtaacccccgggtttggggggacccccggggttaaacccgttcggggtccccgtaaccccggtttcccctacccccccggaaccccgtccccgttaaaccccggtaaccccgggg

SEQ ID NO: 418340 - DNA, 709 bp, Homo sapiens
  misc_feature: GZ8MTXP01BAFOB.21.78.H01.1.454.CMB.2.raw
  modified_base (676)..(676): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctggttttccttgttgctatttcaaaaggtgtccagtgtgaggtgcagttggtggagacgtggaggaggcttgatccagccgtgggggtccctgagactctcctgtgcagtctcgtgggttcgtcgaggtggcactacatgagcgtgggtccgccgaggtcctccgaagggggaacgggtccgtagggagtcggtattcccgttactacttttagtttataggtaggttcggtaacccccacgaacttaacctacaacaaacgtacctccggtaagggaaaccggggtccctactttacccaaccgattacctacgaaagaacgtaaaccactttaccgaaggtaaacactaatttagtacttactaacaaagttgaaactaaaccgtggaaacgacgacccggaaggaccaacgggtaccagttacgtacttacggtgggtaaggttcggggactttactttaccgggtcgtaaccccgggttcgggggccccgggttaaccctcggggttacccaaccccgttcccnccccccgacccgtaacccgaaccgaaccccggg

SEQ ID NO: 418341 - DNA, 613 bp, Homo sapiens
  misc_feature: GZ8MTXP01DGF04.21.78.H01.1.454.CMB.2.raw
  modified_base (303)..(303): a, c, t, g, unknown or other
  modified_base (360)..(360): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagcgtgggtcccncaggctccgagggaaggcctggagtggatctcactttattatgtggtcgtaccccanatactacacaacgactccggtagaacgggccattccaccatcctacaagaagaactaattccaaaggaaaccataattcgaattctaacaaagtcgaaattaaccctggaagacgccgaaggacacgggacctaatgtaattacgtggtggtgggacttatttccgtacggacccccggttggggggccccggggttaaccctgggtcccaacccggttccccaccccgacccctccgaaccgaaccccgggg

SEQ ID NO: 418342 - DNA, 670 bp, Homo sapiens
  misc_feature: GZ8MTXP01CMFKN.21.78.H01.1.454.CMB.2.raw
  modified_base (513)..(513): a, c, t, g, unknown or other
  modified_base (643)..(643): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggtcttgatccagccgtgggggtccctgagactctcctgtgcagtctcgtgggttcgtcaggtggcgactacagtgagcgtgggtcccgccgaggcctccggaaggggaacgggccgtagggagtgggattccttactacttttatttagtaggttggtacggtaacccccacgtaattacctaacacgaaacgaccgtcccgggtagaaacggggcctaacttccaacctattaccacgaagaaacgtaacctaaacgttacccgaaaggaaactactatttacgtattaccttaanaaaagtcgaaataaccgtaggaacgacgaccgaagacgacggacctatacgtattacgtgtggtcgggcttacttacgtacggccccggttgggggccccgggttaaccctggtacccaacccgttcccnccccacccgtcccgaaccgaacccggg

SEQ ID NO: 418343 - DNA, 561 bp, Homo sapiens
  misc_feature: GZ8MTXP01ANTIX.21.78.H01.1.454.CMB.2.raw
  modified_base (448)..(448): a, c, t, g, unknown or other
  modified_base (473)..(473): a, c, t, g, unknown or other
  modified_base (536)..(536): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgcaggctccgaggggaagggcctgggagtggatctcacttatttatagtggtcggtacccacatactacacaagactcgtgagggccgatcacatctcagaagacaattccaaggaacactattgtatcttacaaatgaataactgganagccgagacacggcagtgtattacnggtgtggggctatttacgtcggacccgttgggggcccggttaaccctggccgtaacccgtccnccccacctcccgaaccgtaaccggg

SEQ ID NO: 418344 - DNA, 709 bp, Homo sapiens
  misc_feature: GZ8MTXP01BU9WS.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgagttggtggagacgtggaggaggcttgatccgaggtccgtcgggggtcctgacgactctctgtgcagtctcgtgggttcgtcgaggtggcgactacatgagcgtcgggtccgccgaggctcccggaagggaacgggccgtggagtggactctactactttattagtaggtggtacgtaccactactacacacgaacgtacctcggtagaacgggccctagttaccaactatactacaagaacgaactaacttacgaaacggaactaacgtattacgtacttacttaactaaatacgtaaacgtaaacgtaggaacgtaacgaccgaagaaccaacgacctagtacgtaacgttacgtggttaacgggttacggacgttttaacgtttacggtacccgggtaccccgggttacggggggttacccccgggttaacccggttcgggttacccctaaccccgttccccgtaccccccgttaacccgttaacccccgaacccgggttaaaccccggg

SEQ ID NO: 418345 - DNA, 724 bp, Homo sapiens
  misc_feature: GZ8MTXP01EOHS4.21.78.H01.1.454.CMB.2.raw
  modified_base (474)..(474): a, c, t, g, unknown or other
  modified_base (558)..(558): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgagttgcagttggtggagactgggaggaggcttgatccgagccgtgggggtccctgagactctcctgtgcagtctcgtgggttcgtcgagtggcgactacatgagcgtcgggtcccgcgaggcctccggagggaacgggcctggagtggatctactactttatttagtaggtggtacggtaacccccatatactacacaagacctccggtagaacgggccacttacacatctacaagaaacactaacttcccgaaaggtaaaccaacttattagtacttaccttaanaaaagttcgtaaaactaacccgtggaaacgacgggacccgaagggaacctaaccgggaccttaagtacgggttaactttaacgngggttcggggttacggggactttaaacgttttaccggtacccgggaaccccccgggttggggggggaacccccggggttaaaccccgttcggggtacccccgtaaccccgggttccccctacccccccggaaccccttcccggaaaaccccgggtaaccccggggg

SEQ ID NO: 418346 - DNA, 795 bp, Homo sapiens
  misc_feature: GZ8MTXP01D0DIC.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcgtaggttggtggagacgtgggaggaggtcttgactccgacgtccggtcgggggtccctgacgtactctcctgtgctagtctcgtgggttctcgaggtggacgactacagtgagcgtcgggtccgccgaggcctaccggaggggaacggcgtaggagtggtacttctactaacttttatttaagtaggtggtacgtaacccccactactaactacacgtaaacgaccgtccggtaggaaacggggtcctaacttccgaacctactacctacgaaacgaaacgaaactaacttaaccgaaacggtaaaccctattaagttagtaacttaccttaaactaaaagttacgtaaaacgttaaaccgttaggaaacgaccggaaccgggaaacggaacccggtaacgggtaacccttaagttaggtttaacgtttacgttgggttaacgggttacgggggttactttaacggttttacccggttaccgggtaacccccgggttacggggggaccccggggttaaacccgttccgggttacccctaaccccggttccccgtaccccccttaccccgttaacccgaaacccgggtaaccccggg

SEQ ID NO: 418347 - DNA, 688 bp, Homo sapiens
  misc_feature: GZ8MTXP01E1E8P.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgagactctcctgtgcagtctcgtgggttcgcaggtggcgactacatgagcgtgggtcccgcgaggcctccgaggggaacgggcctggagtggactcctactactttagtttacgtaggttggtacggtaaccccacgtaatacctacacgaaacgtaccgtccggtaggaacgggcctattaccaacgatctacaagaacgaactaacttccgaaaggtaaaccatattagtaacttacttaacaaatacggtaaactaacccgtaggaacgacggacggaacgaccaacgggcctaagttgttaactacgtgggtgggtcgggttacttacggttttaccgaccgggtaccccgggttacggggggaccccgggttaaccctcggggtacccctaacccggtccccgtacccccgacccgtaacccgaaccggtaaccccggg

SEQ ID NO: 418348 - DNA, 592 bp, Homo sapiens
  misc_feature: GZ8MTXP01CH7A2.21.78.H01.1.454.CMB.2.raw
  modified_base (407)..(407): a, c, t, g, unknown or other
  modified_base (412)..(412): a, c, t, g, unknown or other
  modified_base (430)..(430): a, c, t, g, unknown or other
  modified_base (453)..(453): a, c, t, g, unknown or other
  modified_base (475)..(475): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagacgtgggaggaggcttgatccgagccgtgggggtccctgagactctcctgtgcagtctcgtgggttcgtcagtggcgactacatgagcgtgggtccgcaggctccgaggggacggctggagtggatctctactttatttatagtggtagtacccccatatactacacaacgactccgtagaacgggccgatcaccatctanagaanacaatcaagaacactatntactctacaaatgaataactganacgaccgagacacggaccagtnttatacgtggtggtggggctaactttcgttacggcccccggttgggggccccggggttaacccttcgggtacccgtaacccgtcccgtaccccaccctcccgaacccgtaacccggg

SEQ ID NO: 418349 - DNA, 725 bp, Homo sapiens
  misc_feature: GZ8MTXP01C4SCF.21.78.H01.1.454.CMB.2.raw
tcagtcgtcgctcgcacgaccggtgctcgatttagtgtgagtagttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccagccgtgggggtccctgagactctcctgtgcagtctcgtgggttcgtcgaggtggcgactacagtgagcgtcgggtcccgcgaggcctaccggaaggggaacgggccgtagggagtggactctctaactttatttagtaggtggtacgtaacccactatactacacaacgtacctcggtaggaaacgggccgtacttaccaacctatcctacaaggaaacaactaacgttacccgaaaggaaactacttaatttacgtaacttaaccttaacaaaaagttcggtaaaaacttaaacccgttgggaaaacgacggaaccccggaaggacccaacgggaccctagttacggtaattacgtgggttgggtcggggttacttacgttttaaccgtccggaccccgggttaggggggccccgggttaaaccccgttcggggtacccctccccggttacccgtaccccccttaaccccgttaaccccgaacccggtaaccccggg

SEQ ID NO: 418350 - DNA, 690 bp, Homo sapiens
  misc_feature: GZ8MTXP01BVPX2.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgttgggttttccttgttgctatttcaaaaggtgtccagtgtgaggtgcgagttggtggagacgtggaggaggcttgatccgagccgtgggggtccctgagtactctctgtgcagtctcgtggttcgtcaggtgcgactacatggagcgtcgggtcccgcgaggcctaccggaggggaacggccgtggagtggatctactactttatttagtaggtggtacgtaccccactatactacacaacgactcggagaacgggcctactccacatcctagaagaacgaactaacgttaccgaaacggtaaacctacgttaatttacgaacttacttaaacctaaaagttacggtaaaacttaacccgtaggaaacggaccgggaaccgaacgggaaccaaccggacctaagttcggttaattacggttgggtgggtgggttaccttaagtttccgtccgggaacccgggttcggggggacccgggttacccttcggggtaccccaacccgttcccgacccccaccccgtcccgaacccggtaacccgg

SEQ ID NO: 418351 - DNA, 665 bp, Homo sapiens
  misc_feature: GZ8MTXP01C6XBQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgcaggctccgagggaggcctggagtggatctctactttatttatagtggtcgtaccccacatactacacaagacctccggtagaacgggcccgattccacctatcctcaagaaacgacaacttccaaaggaaactactaatttagtattacttacaaaatgaaagttaaccctggaacgacgaccgaaggtaccaacgggaccctaagttcgttaactttaaccgtggttcgggtacgggggttacttacgtttttaccgtacgggtaacccccggttcgggggggaccccgggttaaacccgtcggggtacccaaccccgggtttccctccccccgaacccgttccccgaacccggtaaccccgggg

SEQ ID NO: 418352 - DNA, 609 bp, Homo sapiens
  misc_feature: GZ8MTXP01AC11Q.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgaaggggaacggggcctgggagtgggatcgtctaactttatttagtaggtggtcggtaccccacatactacacaacgactccggtagaaacgggccgtattccacatcctacaagaaacgactaaattcccaaggaaacactattgtaattcttaacaaatgaaacttaccgagagacgaccgaggaccacggaccatgtatacgtggtgtggggctattccgtcggacccggttcgggggcccgggttacctgggaccctaaccgtccctcccccaccctcccgaaccgtaacccggg

SEQ ID NO: 418353 - DNA, 736 bp, Homo sapiens
  misc_feature: GZ8MTXP01AY758.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtcctgagactctcctgtgcagtctcgtgggttcgtcgagtggcgactacatgagcgtcgggtccgccgaggcctccggaaggggaacgggccgtagggagtgggactcgtactaacgttttatttagtaggttggtacggttacccccaactactaactaaccaactaaacggtacccttcccggtagggaaacggggaccctactttacccaaccctattaccctacgaaagaaacgtaaacctaaacgttaccccgaaagggaaacctacttaagtttacgtaaacttaccttaacaaaattacggaaaactttaacccggtagaaacggaacggaaccggaacggaaccaccggacctagtacgttaattacgtggttaaggtcgggacttacgtttaccgtaccgggaccccggttcggggggacccggttaacccgttcgggtaccctaaccccggtccctaccccccaccccgtcccgaaccccggaaccggg

SEQ ID NO: 418354 - DNA, 693 bp, Homo sapiens
  misc_feature: GZ8MTXP01A2H0Z.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggctccgagggagggcctggagtggatctctacttattatagtggtgtacccacatactacacaacgactccgtagaagggcctattcaccatctacagaacgaactaacttaccgaaggaacactattagtaacttcttaacaaattagaaacttaaacctaggaacgaacggacccgaaggtaccgaaccgggaccctaagttacggttaactttaccggttagggttcgggttacggggggttccttaaacggttttacccggttccggtaacccccggggttcggggggttaccccgggggttaaaccccggttcggggtaccccgtaacccggttacccccgtcccccgttaacccccgtaaccccgaacccggtaaacccccgggg

SEQ ID NO: 418355 - DNA, 806 bp, Homo sapiens
  misc_feature: GZ8MTXP01CCHXA.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtggaggaggcttgatccagccgtgggggtcctgagactctctgtgcagtctcgtgggttcgcgaggtgcgactacgatgagtcgtcgggtcccgccgaggcctaccggaaggggaacggggcctagggaagtggacttcgtactactttatttagtaggtggtacgtaccccagtactactacaacgaacgaccgtcggagaaacggggtcctacttaccaaccccgtatcctacgaagaaacgaactaagttacccaaagggtaaacctacctaagtttacgtaaacttaccttaaacgaaaagttaacgtaaaacggttaaacccgttaacgggaacggaaacccgggtaccggaaaccggggaaaccccgaaccgggtaaccccgtaaggtttaaacggttaaaacgtttccggttaggttaacggggtttacgggggttactttaaaccgttttacccgggttacccgggtaacccccggggtttaccggggggttaaccccggggttaaaccccgttccgggtaccccgtaaccccggttccccgtacccccccgttaaccccgttaaccccgaacccggttaaacccccgggg

SEQ ID NO: 418356 - DNA, 632 bp, Homo sapiens
  misc_feature: GZ8MTXP01BGQ0P.21.78.H01.1.454.CMB.2.raw
  modified_base (488)..(488): a, c, t, g, unknown or other
  modified_base (509)..(509): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccccagactctcctgtgcagtctcgtgggttcgtcagtggcgacacatgagcgtgggtccgccgaggcctccgaaggggaacggccgtggagtggatctctagtttattagtagtggtcggtaccacgactactacaacagtaaccgtccgtggaaacgggcccgtattccaacctatctacaagaacgaactaacttccgaaaggaaaccactaatttagtaacttcttaacaaattagaaacttaacgnggaagacggaccgagaaccgnggcctaagtcgttaatacgtggtggtaaggggtcttagtttaccgttcgtacccgggtgggggccccgggaccttcgggtccacccgtcctacccccaccgttcccaaccgttaacgggcccc

SEQ ID NO: 418357 - DNA, 582 bp, Homo sapiens
  misc_feature: GZ8MTXP01AP4FP.21.78.H01.1.454.CMB.2.raw
  modified_base (358)..(358): a, c, t, g, unknown or other
  modified_base (401)..(401): a, c, t, g, unknown or other
  modified_base (451)..(451): a, c, t, g, unknown or other
  modified_base (479)..(479): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgcaggctccgaggggaggcctggagtggatctctactttattatagtggtgtaccccanatactacacaagactcgtgaacgggccatcacatctacagaanacaacttccgaaggaacactattgtacttactacaaatgaaatactgganacgaccgagacgacggcagtgtattacnggtgtgggcttagtttcgtccggaccccgttggggggttcccggaacccgttcgggtcccaacccggttcccacccccgttaccctcccgaaccgaacccggg

SEQ ID NO: 418358 - DNA, 752 bp, Homo sapiens
  misc_feature: GZ8MTXP01AJ3XD.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagctgggtcccgccgaggctccgaggggaacgggcctgggacgtggactctctactttatttagtaggttggtcggtaaccccaacgtataactaaccaacgaaacgtacccgtcccggtaggaaacgggggtccctaactttccaaccctaatcccttacgaaagaaacggaactaaattaccccaagggaaacaacctatttagtaacttaccttaacgtaaaactagaaaacttaaacccgtaggaaacggaaccggacccggaagggaaccacggggaccctaaagttgggttaactttaccgtgggttggggtacgggggttacttaacgttttaccgttacccgggtacccccgggtttcgggggggacccccgggggttaaaccccgttcggggtacccctaaccccggttcccgtacccccccaaccccgtccccgaaccccggtaaacccgggg

SEQ ID NO: 418359 - DNA, 746 bp, Homo sapiens
  misc_feature: GZ8MTXP01CD8IP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccgagccgtgggggtccctgagactctcctgtgcagtctcgtgggttcgtcgaggtggcgactacagtggacgtcgtcgggtcccgccgagggcctaccgggaggggaacggggcccgtagggaggtggattcttctacttttaatttagtaggtggtacggtacccccatataacctacaacgaaacgtaccgttccggtaggaaacggggccctacttaccacctatctacgaagaaagacctaaattcccgaaggaaactactattagtaacttacttaaacaaattacgtaaactaaccgtaggaacgaacggacccggaaggaaccacgggtacctaagttacgttaactttaaccggtgggttaacgggttacggggttcctttaaacgtttacccggttaccggtacccccggggttaccgggggggttaccccgggttaaaccccgttgggtaccccgtaacccggttcccccttaccccccgaccccttaaccccgaacccggtaaccccggg

SEQ ID NO: 418360 - DNA, 748 bp, Homo sapiens
  misc_feature: GZ8MTXP01CHCOV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgctagtctcgtgggttcgtcaggtcggcgactacatgagtcgtcgggtcccgccgaggcctaccggaggggaacgggccgtagggagtgggactccttacgtaactttatttagtaggtggtacgtaaccccactactactacacgaacgacctcggagaacggggcctacttaccacctatctacgaagaacgaactaacttccgaaaggtaaactactatttacgtaattccttaacgaaaattacggtaaacttaaaccgtaggaaacgaccggacccggaaacggaccgaaccggtaccctaagttacggtttaacgttaccgttgggttaacggggtcggggttacctttaacgttttaccccggttccgggtaacccccggggttcgggggggttaccccgggttaaccccggttcgggtaccccgtaaccccggttcccctaccccccgttaccccgttaaccccgaacccgggtaaaccccgggg

SEQ ID NO: 418361 - DNA, 643 bp, Homo sapiens
  misc_feature: GZ8MTXP01CDEXZ.21.78.H01.1.454.CMB.2.raw
  modified_base (333)..(333): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagctcgggtccgcaggctccgagggaaggcctggagtggatctnacttattatagtgtggtaccccacatactacacaagactccgtgaagggccattcacatctacagaagacaattccaaggaaacacgtattagtactcttaacaaatagaaataaaccgtgaagacggaccgacggacacgggaccatagtacttacgtggtggttcgggggttacttacgtttaccgttccgggtaacccccggttcgggggggccccggggttaaaccccgttcgggggtacccctaaccccggttccctaccccccccgttaccccgttaaccccgaaaccccgggtaaccccgggg

SEQ ID NO: 418362 - DNA, 584 bp, Homo sapiens
  misc_feature: GZ8MTXP01A5FRF.21.78.H01.1.454.CMB.2.raw
  modified_base (365)..(365): a, c, t, g, unknown or other
  modified_base (384)..(384): a, c, t, g, unknown or other
  modified_base (404)..(404): a, c, t, g, unknown or other
  modified_base (422)..(422): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtcgggtccgccaggcctccgaaggggagggcctggagtggactctctactttatttatagtggtggtaccccanatactacacaagactccgnggaagggccgattcacatcnagagacaatccaggaacncattgatctacaaatgaatactgagacgcgaggcacggcatgtattacgtgtggtggggttctagttttccgttcggaccccgttcgggggccccggggttaacccgtcgggtccaaccccggttcccaccccccgaccccttcccgaaccccgaacccggg

SEQ ID NO: 418363 - DNA, 639 bp, Homo sapiens
  misc_feature: GZ8MTXP01BJNSU.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagcgtgggtccgccgaggctccgaggggaaggcctggagtggatctctactttatttataggtggtggtaccccatatactacacaacgacctcgtagaacgggccattccacatctacagaaagacaattaccaaggaactactattgtatacttacaaatgaaattaacctgaagacgaccgaaggaccacggaccagtgtaattacgtggtcggttggggcttaacgtttaccgtaccggtaccccgggttcggggggttcccgggggttaaacccccgttggggtaccccgtaaccccggttccccgttaccccccgaccccgttcccgaaccccggtaaccccgggg

SEQ ID NO: 418364 - DNA, 733 bp, Homo sapiens
  misc_feature: GZ8MTXP01AKP74.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgtgggttcgtcagtggcgactacatgagcgtcgggtccgcgaggcctaccgagggaaggcctggagtggatctactactttattataggtggtacgtacccccatactactaccacaacgacctccggtaggaaacgggccgtacttccacatcctacgaaagaaacgaacaaacttacccgaaaggtaaccaactatttacgtattaccttaacgaaaattacggaaaacttaaccgaggaacggaacggacccggaaacgggaccgaccgggtaccctaagttacgggttaactttaaccggtgggttaacgggtacgggggttaccttaaacggttttaccggtacccgggtaacccccggggttcggggggacccccggggttaaaccccgtccggggttaccccaaccccggtttccccgtacccccccaccccgttaaccccgaaacccggtaaacccccggggg

SEQ ID NO: 418365 - DNA, 590 bp, Homo sapiens
  misc_feature: GZ8MTXP01EARPS.21.78.H01.1.454.CMB.2.raw
  modified_base (337)..(337): a, c, t, g, unknown or other
  modified_base (361)..(361): a, c, t, g, unknown or other
  modified_base (373)..(373): a, c, t, g, unknown or other
  modified_base (378)..(378): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctcgtgggttcgtcgagtggcgactacatgagcgtgggtccgccgaggcctcgaggggaacgggcctggagtggatctnacttatttatagtggtgtacccanatactacacaanctcgngaaagggcctatcacatctcaagaagacaattccaggaaacactattgtaatctacaaatgaaattaaaccgtgaagagaccgagacacggaccatgtattacgtgtaaggtggggctagtttacgtcgtaaccccggttcgggggcccgggttaacccgtggtacccgtaaccggtccctacccccgaccctcccgaacccgtaacccggg

SEQ ID NO: 418366 - DNA, 658 bp, Homo sapiens
  misc_feature: GZ8MTXP01EJYPV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgatccgagccgtgggggtccctgagactctcctgtgcagtctcgtgggttcgtcaggtggcgactacatgagcgtcgggtccgccgaggctccgaggggacggccgtggagtggatctctactttattagtaggtggtacgtaccccactatactacacaacgtactcggtagaacgggccctattccactatctacaagaagactaactccgaagaacactattagtacttactactaaagtagaaacgtaaccgtagaacggacggaccgaacggaccgaccggacctagttagttaacttacgtgggtggtcggggttacttacgtttaccggtccggtaccccggggttcggggggccccggggttaacccgttcgggtacccgtccccgttccccaccccccgttaccccgtcccgaacccggtaaccccggg

SEQ ID NO: 418367 - DNA, 572 bp, Homo sapiens
  misc_feature: GZ8MTXP01ARMU3.21.78.H01.1.454.CMB.2.raw
  modified_base (486)..(486): a, c, t, g, unknown or other
  modified_base (547)..(547): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtggggggtccctgagactctcctgtgcagtctcgtgggttcgtcagtggcgactacatgagcgtggggtcccgccgaggctccgaggggaacggggcctggagtgggatctctactttatttatagtggtggtaccccacatactacacaagactccgtagaacggggccatcacatctacagaagacaacttccaaggaacactattgtattctacaaatgaatactgagacgcgaagacaggaccatgtattacngtggtgggctacgtttacgtcggcccgttgggggcccgggaaccctggccaaccgttcccnccccgaccctccgaaccgaacccgg

SEQ ID NO: 418368 - DNA, 606 bp, Homo sapiens
  misc_feature: GZ8MTXP01BXFGQ.21.78.H01.1.454.CMB.2.raw
  modified_base (365)..(365): a, c, t, g, unknown or other
  modified_base (400)..(400): a, c, t, g, unknown or other
  modified_base (406)..(406): a, c, t, g, unknown or other
  modified_base (442)..(442): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgccgaggcctccgaggggaagggcctggagtggatctctactttattatagtggtacgtaccccanatactacacaagactcgagaacgggcatcacatcncagaanacaattaccgaagtaacactattacgtataccttanaaatgaaactacgtgaagacggaccgaaggacgacggacctaagtgttaattacgtgtggtgggttactagtttacgtcggtaaccccggttggggggaccccggttaaccgtcgggtcccaacccggttcccacccccgaccctccccgaaccgtaacccggg

SEQ ID NO: 418369 - DNA, 782 bp, Homo sapiens
  misc_feature: GZ8MTXP01C0MSE.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttagctgagcttgggttttccttgttgcttatttacaaaaggtgtccagtgtgaggtgctaggttggtggagacgtgggaggaggtcttgactccgaggccggtcggggggtccctgacgactctccgtgtcgctacgtcttcgttgggttcgtcgaggtggcgactacatgacgcgtcgggtcccgcgacggtcctaccggaggggaacgggccgtagggagtcggtactcgttactaacgttttagtttagtagggtggttacgtaacccccaacgtaactaacctaacacgtaaacgtacccgtccgggtaggaaacggggaccctaacttaccaacctatacctacaaaggaaactaaactaacttaccgaaaggtaaaaccctaattagtttaacgtacttaacttaaacaaaagttacgaaaacttaaccgtaggaaacgaccgggaaccggaacggtaaccgaccggtacctaagttacgttaacgttacggtggttaacgggtgggttacctttaaacgttccggttaccgggaccccgggttacggggggttccccggggttaaacccttcggggtacccctaaccccgttccccgtaccccccgttaacccgttcccggaaacccggtaaccccgg

SEQ ID NO: 418370 - DNA, 707 bp, Homo sapiens
  misc_feature: GZ8MTXP01D3WBP.21.78.H01.1.454.CMB.2.raw
  modified_base (282)..(282): a, c, t, g, unknown or other
  modified_base (453)..(453): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctaggttggtggagacgtggaggaggcttgatccgagccggtcgggggtcctgagtactctccgtgtgctagtctcgtgggttcgngtagtggacgactacagtggagtcggtcgggtcccgaccgacggccgtaccggaggggaacggccgtagggtagtggtattctactactttaatttacgtaggtggtacgtaaccccatatactacacgaaacgactcggtaggaacgggccctatccgacctatacctanaagaagaactaacttaccgaaaggtaaacctagtaatttagaacttactaaactaaagtaacgtaaacttaaaccgtaggaaacgaccgggaccgaaacgaccgaccgtaccgtagttacgttagttacgtgggtggtcgggttacttacgtttaccgtccggtacccgggttccgggggacccgggttacccgtcgggtacccgtaaccccgtcccctacccccgacccgtaaccccgaaccgtaaccccggg

SEQ ID NO: 418371 - DNA, 673 bp, Homo sapiens
  misc_feature: GZ8MTXP01A027B.21.78.H01.1.454.CMB.2.raw
tcagtcgtcgctcgcacgaccggtgctcgatttagtgtgagtagtttgggtttgggggggagaggtgcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgtgggttcgtcgaggtggcgactacagtgagcgtcgggtccgcaggcctccgagggacgggctggagtggatctctactttatttagtagtggtcgtaccccactatactacacaacgactcgtagaacgggccattccacatctcaagaacaactactaccgaagaaacactattacgtacttacttaacaaattcgaaacttaaccgtaggaacgacgacccggaaggaccgacggaccctagttacgttatttaccggtggttaacgggtcgggggttcttaacgttttacgttcccgggtacccccgggttcggggggccccggggttaaccccggttcggggtaccccgtaaccccgttccccgtaccccccgaccccgttaaccccgaacccggtaaccccgggg

SEQ ID NO: 418372 - DNA, 597 bp, Homo sapiens
  misc_feature: GZ8MTXP01E3VC2.21.78.H01.1.454.CMB.2.raw
  modified_base (368)..(368): a, c, t, g, unknown or other
  modified_base (377)..(377): a, c, t, g, unknown or other
  modified_base (403)..(403): a, c, t, g, unknown or other
  modified_base (406)..(406): a, c, t, g, unknown or other
  modified_base (435)..(435): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccgaggctcccgaggggaacgggcctggagtggatcgtcactttatttagtagtggtgtaaccccanatactacanaagactcgtagaagggccattcacanctnagagacatacagaacacattgtatcttanaaatagaaactaactagagacgacgagacacggaccatgtattacgtgtggtggggactagtttacgtcggtaaccccggttcgggggccccggggttaacccgtggggtacccaaccccggttccctaccccccacccttccccgaacccgaaaccccggg

SEQ ID NO: 418373 - DNA, 715 bp, Homo sapiens
  misc_feature: GZ8MTXP01DS36T.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctattcaaaaggtgtccagtgtgaggtgcagttggtggagacgtgggaggaggcttgatccagccgtgggggtcctgagactctcctgtgcagtctcgtgggttcgtcaggtggcgactacatgagcgtgggtcccgcaggctccgagggaggccgtggagtggatctactactttattagtgtggtacgtacccactatactacacaagacctcgtaggaacggggcctattccactactctacaagaacgaactaattaccgaaggtaaacacttaatttacgtaattacttaacaaaattacgaaacttaaaccgtaggaaacggaacgggacccggaaacgggacccgaacgggtaaccctagttgttaaactttacgtgggttaagggtcgggggttaacctttaacgttttaacccggttaccgggtaccccggggttaccggggggttaccccggggttaaaccccgtcggggttaccccgtaacccccgtttcccctaccccccggttacccccttcccggaaacccccgtaaccccggggg

SEQ ID NO: 418374 - DNA, 754 bp, Homo sapiens
  misc_feature: GZ8MTXP01ETJ0C.21.78.H01.1.454.CMB.2.raw
  modified_base (296)..(296): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctctgtgcagtctgtggtctcagtggcgactacatgagcgtcgggtccncgaggctcgagggacggccgtggagtggtatcctctactttatttataggtggtacgtaccccactataccgtacacgaaagtacctccggtagaaacgggccgtacttaccaccgtatcctacaaagaacgtaactaacgttacccaaagggtaaaccaacgttagtttaacgtaacttccttaacgaaaattcggtaaaaaccttccgtaaggaacggaccggaacccggaaacggaaccgtaaaccggaccgtaaagttacggtttaacgtttaaccggtgggttaacgggttacggggttaccgtttaaccgtttttaacccggtaccgggtaacccccggggtttaccggggggccccgggggttaaaccccttcgggggtaaacccccttcccgggttaccccccgtaccccccgttaaccccggttcccgaaaccccggttaacccggggg

SEQ ID NO: 418375 - DNA, 630 bp, Homo sapiens
  misc_feature: GZ8MTXP01EYZFC.21.78.H01.1.454.CMB.2.raw
  modified_base (178)..(178): a, c, t, g, unknown or other
  modified_base (344)..(344): a, c, t, g, unknown or other
  modified_base (483)..(483): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtntccagtgtgaggtgcagttggtggagacgtgggaggaggcttgatccgagccgtggggggtccctgagactctcctgtgcagtctcgtgggttcgtcaggtggcgactacgatgagcgtcgggtccgcgaggcctaccggaggggaacggcctggagtggatcgtnactttattatggtggtacgtaccccagtatactacacagacctcgtagaaacgggccattaccacatctacaagaacgacaacttccaaggtaaacacgtattagtactacctttagaaaattgaaattaaccaggaanacggacgagacacggacagtgttactagtggtggttgggacttacgttttacgtcggtaccccggttcggggggcccggttaacccgttcgggtaccctaacccgggttcccctcccccgacccgttccccgaaccggaaccccggg

SEQ ID NO: 418376 - DNA, 755 bp, Homo sapiens
  misc_feature: GZ8MTXP01EIW58.21.78.H01.1.454.CMB.2.raw
  modified_base (362)..(362): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagctctcctgtgcagtctcgtgggttcgtcgagtggcgactacatgagcgtgggtccgccaggctccgagggaagggccgtggagtggatctactacttatttatgtggtggtaccccanatactacacaacgactcggtagaacgggccgtattcatcatcctgaagaagaacaacttaccgaaaggaaacctactaatttagttaacttactttaaacaaaagttacggggaaaacttaaacccgttggaaacgggaacggacccgggaacggggaaacccgaaccggggtacccctaagttaccggtttaaatttaacccggttgggtttacggggttaggggggtacctttaaacggtttttaaacccggttacccggggttaaacccccccggggttggggggggaccccccgggggttaaaccccgttcgggggttaaccccctaacccccgggttcccccttaccccccccgtaaaccccccgttccccggtaaaaccccccgggg

SEQ ID NO: 418377 - DNA, 589 bp, Homo sapiens
  misc_feature: GZ8MTXP01B6EG7.21.78.H01.1.454.CMB.2.raw
  modified_base (357)..(357): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggagggactggagtggatctcactttatttatagtggtgtaccccanatactacacaagactccgtgaagggccattcacctatctcagaagacaattccaaggaacactattgtatcttacaatgaataacctgagacgccgaggacacggaccatgtacttacgtggtggtggggctagtttacgttccggaccccggttcgggggccccggggttaacccgtggggtacccaaccccggttcctccccccacccgttccccgaaccgtaacccggg

SEQ ID NO: 418378 - DNA, 560 bp, Homo sapiens
  misc_feature: GZ8MTXP01B13L4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggagggcctggagtggatctcactttatttatagtggtggtaccccacatactacacaagactccgtgaacgggccattcacatctcagaagacaattccaggaacacattgtatcttacaaatgaataacctgagagccgaggacacggccatcgtattactggtggtggggctatttcgtcggaccccgttgggggcccggggaaccctgggtccaaccgtcctccccacctcccgaaccgaaccggg

SEQ ID NO: 418379 - DNA, 759 bp, Homo sapiens
  misc_feature: GZ8MTXP01EF1ST.21.78.H01.1.454.CMB.2.raw
  modified_base (328)..(328): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtggtttcctgtgctattcaaaggtgtcagtgtgaggtgctagtggtggagacgtggaggaggcttgatccagccgtgggggtccctgagactctctgtgcagtctcgtggttcgtcagtggcgactacatgagcgtggtcccgcgaggctaccgaggggagggcctggagtggatcgtntacttatttagagtggtacgtacccatatactacacaacgtactccggtaggaacgggccgtacttcacctaatcctacaaggaaacaactaacgtttaccccgaaaggtaaaccctacttaatttacggtaaactttacccgttaaacgtaaaattaacggtaaaaccgttaaaccccggttaaggtaaacgggaaccgaccccggttaaagggaacccgaaccggggtacccttaacgttacgttaaagtttaccgtggggttaagggttcggggttaactttacgttttaaaccggttcccgggtaaaccccccgggttggggggttacccccggggttaaccccttcgggggttaacccaacccccgggttttaaccccggcccccccaaaccccgttaacccgttaaccccggtaaaccccggggg

SEQ ID NO: 418380 - DNA, 696 bp, Homo sapiens
  misc_feature: GZ8MTXP01EFWVI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtgggagacgtgggaggaggcttgatccgagccgtgggggtccctgagactctcctgtgcagtctcgtgggttcgtcaggtggcgactacatggagcgtcgggtccgcgaggctccggagggagggcctggagtggatctctactttattagtagtggtcgtacccactatactacacgaacgacctcggaggaacgggcctattccacctatacctacaaagaaacgaactaaacttcccgaaaggtaaaacctacttaagtttacgtaacttaccttaacaaaagttacggaaaacttaacccgtaggaaacggacggaacccggaaaggaacccgtacggacctagtacgttaattaccggtgtggggtcggggttacttacgttttacggtaccggtaccccgggttacggggggccccgggttaacccgtcggggtaccctaaccccgggtcccctacccccgacccgttcccgaaccccggtaaccccggg

SEQ ID NO: 418381 - DNA, 558 bp, Homo sapiens
  misc_feature: GZ8MTXP01DSKDU.21.78.H01.1.454.CMB.2.raw
  modified_base (273)..(273): a, c, t, g, unknown or other
  modified_base (333)..(333): a, c, t, g, unknown or other
  modified_base (360)..(360): a, c, t, g, unknown or other
  modified_base (401)..(401): a, c, t, g, unknown or other
  modified_base (407)..(407): a, c, t, g, unknown or other
  modified_base (409)..(409): a, c, t, g, unknown or other
  modified_base (419)..(419): a, c, t, g, unknown or other
  modified_base (424)..(424): a, c, t, g, unknown or other
  modified_base (431)..(431): a, c, t, g, unknown or other
  modified_base (468)..(468): a, c, t, g, unknown or other
  modified_base (480)..(480): a, c, t, g, unknown or other
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgnagtggcgactacatgagctgggtccgcaggctccgagggaagggcctaggagtggatctntactttattatagtggtgtaaccccanatactacacaagactccggtagaaagggccattccacatcnaagaananaatacagaanacatntatctanaaatagaagtaactagagagacgagacacggaccatntatatgtgtggngtacttagttacgtacccgttcggggccggggaccgtcgtccgtaaccgtccctccccaccctcccaaccgaacccgg

SEQ ID NO: 418382 - DNA, 696 bp, Homo sapiens
  misc_feature: GZ8MTXP01CRDJA.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcgggtcccgccgaggcctccggaggggaacggccgtggagtggatcctactactttatttagtaggttggtacggtaaccccactagtaactaacacgaaacgtaccgtccggtaggaacggggcctactcgaacctactacctaccaaagaaacgtaactaaacgttaccgaaaggaacctaacgtattacgtaacttacttaaactaaaagttacgaaacgttaaacccgtaggaacgaacggaccggaaacggaaccgaccgacctaagttacgtaattacgtgggttggtagggttcttaacgtttaccggtccggtacccggttacgggggacccggttacccgttggacccgtaacccgtccctacccccgacctaaccccgaacccgtaaccggg

SEQ ID NO: 418383 - DNA, 713 bp, Homo sapiens
  misc_feature: GZ8MTXP01EVGJE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcaggtcggcgactacagtgagtcgtcgggtcccgcgaggcctccggaaggggaacgggcctggagtggatctactactttatttagtaggtcggtacgtaaccccactatactacacaacgactccgtagaacgggccatccacatctacaagaaacgactaaacttcccgaaaggtaaacccagttaactttagtaacttaccttaaataaaagtacgaaaacttaaaccgtaggaaacgacgaccggaagaccgaacggctaagttgtaacttcgtgggtggttacggggttacttaaacggttttaccgtccggggtaacccccggggttggggggacccccggggttaaaccctttccgggggtaacccctaacccccgggttcccctacccccccgttaccccgttaaccccggaaaccccgggtaaccccgggg

SEQ ID NO: 418384 - DNA, 614 bp, Homo sapiens
  misc_feature: GZ8MTXP01CZBR3.21.78.H01.1.454.CMB.2.raw
  modified_base (168)..(168): a, c, t, g, unknown or other
  modified_base (190)..(190): a, c, t, g, unknown or other
  modified_base (224)..(224): a, c, t, g, unknown or other
  modified_base (240)..(240): a, c, t, g, unknown or other
  modified_base (257)..(257): a, c, t, g, unknown or other
  modified_base (264)..(264): a, c, t, g, unknown or other
  modified_base (268)..(268): a, c, t, g, unknown or other
  modified_base (272)..(272): a, c, t, g, unknown or other
  modified_base (274)..(275): a, c, t, g, unknown or other
  modified_base (277)..(277): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtagctattanaaaaggtgtcagtgtgaggtgngtagttggtgagacgtggaggaggcttgatccgngccgtggggcctgganctctctgtgcagtctgnggttcgngagngcananngngcgcgcgcgcgcgcgaggacggcgtggagtgatactactattagttagtagtgtacgtaccactactactacacgaacgtacgtcgtacgaacggacgtactacactactacgtacaacgaaagaacgtaactaacgaacgaaactaactaagttagtaattactaactaaacgtaagtaaacgtaacgtacgaacgacgacgaacgaacgacgacgtacgtagtacgtacgtgtggtacggttacgttacgttacgtacgtaccggttaccgggttaccggttaccgtccgtaccgtcccgtcccgtacccgttacccgtaaccgaaccgtaaccg

SEQ ID NO: 418385 - DNA, 703 bp, Homo sapiens
  misc_feature: GZ8MTXP01CH7RX.21.78.H01.1.454.CMB.2.raw
  modified_base (342)..(342): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttctcgagtggcgactacatgagctcgggtccgcaggctccgagggaacggcctaggagtggatctctacttattanagtggtcgtaccccacatactacacaacgactcgtagaaacgggccgtaattccaaccgtatcctacaagaaacgaactaaacgttacccgaaaggtaaacctaacgtaatttacgttaacttaccgttaacaaaagttaacgtaaaacttaaacccgttaggaaacgaacgggaccggaaacggaaccgaaccgggaccctaaagttaggttaactttaacgtgggttaagggtcgggggttacttaacggttttaccgttaccggtaccccgggttcgggggaccccggggttaaacccgttcggggtaccctaacccgttcccgtcccccacccttaacccgaaccggtaaccccggg

SEQ ID NO: 418386 - DNA, 798 bp, Homo sapiens
  misc_feature: GZ8MTXP01ELIA8.21.78.H01.1.454.CMB.2.raw
  modified_base (249)..(249): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttacaaaaggtgtccagtgtgaggtgcgtagttggtggagacgtgggaggaggtcttgactccgagtccggtgggggtcccngacgactctctgtcgctagtctcgtgggttcgtcgaggtcggacgactacagtggacgtcgtcgggtccgaccgacggccgtaccgggaagggggaacgggtccgtagggaggtggtacttccgttacttaacttttaagtttaagtaggttggtaccgtaaccccaactaactaactaacaacgaaacgtaccgttccgggtaagggaaacgggtccctaactttacccgaacctacttaccgtaacgaaacgtaaacgtaaacctaaacgttaccgaaacggtaaaacctactttaagttacttaaacttacttaaactaaaagttacgtaaaacgttaaaccgtagggaacgacggaaccggaacggaaccgacggacctaagttacgttaagttacggttgggtaacggttcgggttacttaaccggttttaccggtacccgggtacccccgggggttacgggggccccgggttaacccgtcgggtacccctaaccccggtcccctacccccgttaacccgtaacccgaacccggtaaccccggg

SEQ ID NO: 418387 - DNA, 860 bp, Homo sapiens
  misc_feature: GZ8MTXP01D56PE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggtttttccttgttgcttatttacaaaaggtgtccagtgtgaggtgcgtaggttggtggagacgtgggaggaggtcttgatccgaggtccggtcgggggtccctgacgtactctccgtgtgctagttcttcgttgggttcgtcgaggtggacgaactacagtggagtccggtcggggtccccgccgacggccgtaccgggaagggggaacgggtcccgtaggggagtcgggtacttccgttacttaacgttttatttaagtagggttcgggttacggtaacccccaactaactaactaaccaacgtaaacgtacccgttccgggtaagggaaaccgggtcccgttaactttacccaaaccctaagttacccttaacgaaacggtaaacggtaaaccttaaaccgttacccggaaaacggtaaaaccctaacttaaagttttacgttaaactttaaccttaaacctaaaaagttaacggtaaaaccttaaacccgtagggaaacgaacgggacccggaaacgggaaacccgtaccggtaacccttaagttacgttaacgtttaccggtaggttcggggttacgggttactttaccggttttaccgtacccgggtacccgggttccggggggacccggttaacccggttcggtaccccgtcccgtccccctacccccgaccccgttaacccgaacccggtaaccccggg

SEQ ID NO: 418388 - DNA, 820 bp, Homo sapiens
  misc_feature: GZ8MTXP01BTWG8.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgaggtggcgactacatgagcgtgggtcccgccgaggcctccggaggggaacgggccgtgggaagtggattccgtactaacttttatttagtaggtggttacggtaaccccctactaactacctaacacaaacgtacctccggtagaaacggggcccgtaacttccaacctactcctacaaaggtaaacgaacctaacgttacccgaaagggtaaacctaactaagtttacgtaacttaccttaacaaaagttacgtaaaacttaaacccgttaggaaacggacgggaacccggaaacgggaaccggaaccggtacccgtaaagttcggtttaaacgtttaaccggttggggttaacggggttcgggggttacctttaaacggtttttaaccccggttaccgggggtaaccccccgggttaccgggggggggttacccccgggggttaaaacccccggttcggggttacccccgtaaccccggggtttccccctaccccccccgttaacccccgtttaaccccggaaacccccggtaaaccccggggg

SEQ ID NO: 418389 - DNA, 690 bp, Homo sapiens
  misc_feature: GZ8MTXP01A5K1W.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgaggtggcgactacatgagcgtgggtccgccgaggctccgaggggaacgggcctgggagtggatcgttctactttatttataggtggtacggtaccccactatactacacaacgactccggtagaacgggcctattcaccatcctacagaacgaactaacttccaaaggaaccactattagtacttacttaactaaatagaaactaaacctaggaacgacggaccgaaggaaccgaccggacctaagttgttaacgtttacgtggttgggttcgggggttactttaacgtttaccgttaccggtacccccggggttcggggggttccccggggttaaaccccggttcgggtaccccgtaaccccgttccccgtaccccccgttaccccgttaacccgaaccccggtaaccccgggg

SEQ ID NO: 418390 - DNA, 772 bp, Homo sapiens
  misc_feature: GZ8MTXP01BP36S.21.78.H01.1.454.CMB.2.raw
  modified_base (620)..(620): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaggtgtccagtgtgaggtgcgtagttggtggagacgtgggaggaggtcttgactccgacggtccggttcgggggtccctggacgtaccttctccgtgtcgctagtcgtcgtgggttcgtcgaggtcggacgactacagtgacgtcgtcgggtcccgccgaggccgtaccggaaggggaacgggccgtagggacggtggtacttccttacgttaacgttttatttagtaggttcggtacggtaacccctaactaattaacctaacgaccgtaaacgtaccgttccgggtagggaaaccggggtcccgtaacttacccgaacctacttaccacgaaacgaaacgtaacctaaacgtttaccggaaagaaactaacgttatttacgtaacttacgttaacaaaattacgaaacgtaaacgtggaagacggacgaacggacacggtacngttcgtaacttgttggtcgggttcgggttctttaacggtttaccgttcccggggtaaccccgggttcggggggttacccgggttaccccctggggtacccctaaccccggttccccaccccttaccccgtaacccgaacccgggtaacccgg

SEQ ID NO: 418391 - DNA, 577 bp, Homo sapiens
  misc_feature: GZ8MTXP01CUFAK.21.78.H01.1.454.CMB.2.raw
  modified_base (354)..(354): a, c, t, g, unknown or other
  modified_base (363)..(363): a, c, t, g, unknown or other
  modified_base (388)..(388): a, c, t, g, unknown or other
  modified_base (397)..(397): a, c, t, g, unknown or other
  modified_base (409)..(409): a, c, t, g, unknown or other
  modified_base (424)..(424): a, c, t, g, unknown or other
  modified_base (429)..(429): a, c, t, g, unknown or other
  modified_base (437)..(437): a, c, t, g, unknown or other
  modified_base (458)..(458): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggagcttgatccagccgtgggggtccctgagactctcctgtgcagtctcgtgggtcgtcagtgcgactacatgagctgggtcccgcaggcctccgagggaaggcctggagtggatcgtcactttattatagtggtcgacccanatactacanaagactcgagaagggccatacacanctacagaanacaatccaaganactatcgtatctaanaatanaagtaacngagacgacgagacgacgactntagtatgtggtggtcgggttacttacgttacggtaccggtacccgggttacgggggcccggttaccgtcggtaccctaacccgtcccctaccccgacccgtaacccgaaccggaaccgg

SEQ ID NO: 418392 - DNA, 662 bp, Homo sapiens
  misc_feature: GZ8MTXP01ERPB5.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcaggtggcgactacatgagcgtcgggtcccgccgaggcctccggaggggaagggccgtggagtggatcgtactactttatttataggtggtcgtaccccatatactacacgtaagacctcgtagaacgggccgtattccacattctacaagaaacgactaacttcccgaaaggtaaaccacttagtttacgtaacttaccttaacaaaattcggaaaacttaaccgtggaaacgacggaccgaaggaccgacggacctagttgttaacttacgtggtggtgggaccttagttttaccgtccggaccccgggttcgggggaccccgggttaacctcggggtaccctaaccccggttccctacccccgaccgtccccgaacccggtaacccggg

SEQ ID NO: 418393 - DNA, 720 bp, Homo sapiens
  misc_feature: GZ8MTXP01DM0KA.21.78.H01.1.454.CMB.2.raw
  modified_base (429)..(429): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgagactctcctgtgcagtctcgtgggttcgtcaggtggcgactacagtgagcgtgggtccgcaggcctccggaggggaacgggcctggagtggacttcgtactactttatttagtaggtggtacgtaccccactatactacacaaacgactccggagaacgggcctattaccaccctagtcctanaagaaagaacaacttccgaaagaactactatttagtacttactaacaaagtagaaacttaactaggaacggaacgaccggaaaggacccgaacggtacccaaagtttagttaaacgtttaccgtgggttaacgggttacgggggttacctttaaacgtttttacccgtacccggggtaacccccgggttacgggggggaccccggggttaaaccccgttcggggtacccctaaccccgggttccccctacccccgttaccccgtaaccccgaacccgggtaaaccccgggg

SEQ ID NO: 418394 - DNA, 597 bp, Homo sapiens
  misc_feature: GZ8MTXP01D8MFC.21.78.H01.1.454.CMB.2.raw
  modified_base (401)..(401): a, c, t, g, unknown or other
  modified_base (491)..(491): a, c, t, g, unknown or other
  modified_base (571)..(571): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagcgtgggtccgcgaggctccgaggggaacggcctggagtggatctctactttattatagtggtacgtacccacatacacacaagactcgagaacgggccgattccacatcncaagaaacgacaattaccgaggaaacactattgtaatacttaacaaatacgaaacttaaccgtgaagacgaccggaagacgacgacagtntaattacgtgggtggtgggttactatttacgtcgaccccgggttggggccccgggttaacctgggaccctaaccgtcccnccccaccgtcccaaccggtaacccgg

SEQ ID NO: 418395 - DNA, 712 bp, Homo sapiens
  misc_feature: GZ8MTXP01ADZ1I.21.78.H01.1.454.CMB.2.raw
  modified_base (377)..(377): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctctgtgcagtctcgtgggttcgtcgaggtggcgactacagtggagcgtcgggtccgccgaggctaccggaggggaacggggcctgggaggtggatctctaactttatttagtaggtggtacggtaccccanatactacacaacgactccggtaggaacgggcgtacttacacatctacgaagaaacgactaaacttcccgaaggaaacactattagtaacttacttaacaaattgaaacttacctaggaacgacggaccgaggaccgacggacctagttagttaactttacggtggttggggtcggttcttaaaccgttttacggttaccccgggtaaccccggggttaccggggggggttacccccggggttaaacccggttcccgggggttacccctaaccccgggttaccccctaccccccgttacccccggtaaccccgttaaaccccggtaaccccggggg

SEQ ID NO: 418396 - DNA, 648 bp, Homo sapiens
  misc_feature: GZ8MTXP01A3NT8.21.78.H01.1.454.CMB.2.raw
  modified_base (401)..(401): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcagtggcgactacatgagcgtgggtccgccgaggctccgaggggaacggcctggagtggatctctactttattagtagtggtgtaccccacatactacacaagactcgtgaacgggcatcacatctanagtaagacaattccgaagaacactattgtaacttcttaacaaattagaaataacctaggagacggaccgaaggaccacggacctagtgttaacttacgtgggtgggtcggggttactaacgttttaccggttaccggtaacccccgggttcggggggccccggggttaaaccccgtcggggtacccctaaccccgggttcccctaccccccgaccccgttaaccccgaaaccccgggtaaccccggg

SEQ ID NO: 418397 - DNA, 661 bp, Homo sapiens
  misc_feature: GZ8MTXP01B6W46.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtccctgagactctcctgtgctagtctcgtgggttcgtcaggtggcgactacatgagcgtgggcccgcgaggcctaccggaggggaaggccgtagggagtggattcgtctaactttatttagtagtggtacggtaccccactataaccgtacacaagaccgtccggtagaacggggtccattaccgaccatactacaagaaacgaacaaacttccgaaggaaacctactaattacgtaatacttaactaaataacgtaaactaaacctaggaagacggaccgaggaaccgacggacctagtagttacttacgtggtaacggtgggttactacgtttacgtccggacccggttcgggggcccgggttaacccgtgggtccctaaccggtccctacccccgttacccgtcccgaaccgtaaccccggg

SEQ ID NO: 418398 - DNA, 588 bp, Homo sapiens
  misc_feature: GZ8MTXP01AYG1D.21.78.H01.1.454.CMB.2.raw
  modified_base (340)..(340): a, c, t, g, unknown or other
  modified_base (356)..(356): a, c, t, g, unknown or other
  modified_base (473)..(473): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaagggcctggagtggatctcacttatttanagtggtggtaccccanatactacacaagactcgagaagggccgattcaccatctacagaagacaattccaggaacacattgtatctacaaatgaataacctgagacgaccgagacacggccagtgtattacgnggtggtgggggctagtttaccgttcgggacccccgttgggggcccggggttaaccctggggtccctaaccccgggtccctaccccccaccccgtcccgaacccgtaaccccgggg

SEQ ID NO: 418399 - DNA, 569 bp, Homo sapiens
  misc_feature: GZ8MTXP01AP2K5.21.78.H01.1.454.CMB.2.raw
  modified_base (543)..(543): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggcctggacgtggatctctacttatttatagtggtgtacccacatactacacaagactcgtgaagggccattcacatctcagaagacaattccaaggaacactattgtatcttacaaattgaaactaacctgagacgccgagacacggccagtcgtattacgtgtggtggggctagtttacgtcggaccccgttgggggcccgggaacccgttggtccaaccggtcccnccccaccctcccgaaccgaacccggg

SEQ ID NO: 418400 - DNA, 601 bp, Homo sapiens
  misc_feature: GZ8MTXP01BJTVF.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtcccgccgaggcctccgagggaacggcctggagtggatctctactttatttataggtggtgtaccccacatactacacaagactcgtgaacgggctattccacatctacagaacgacaattaccaggaaacactattgtactctacaaatgaaataacctgagacgaccgagaccgacggacctagtgtattacgtggtggtcggggacttacgtttacgtccggtaccccggttcgggggcccgggttaacccgtcgggtccgcccgtccctcccccgacccctcccgaacccgtaacccgggg

SEQ ID NO: 418401 - DNA, 617 bp, Homo sapiens
  misc_feature: GZ8MTXP01C92MB.21.78.H01.1.454.CMB.2.raw
  modified_base (357)..(357): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggctcgagggaagggcctggagtggatctcactttatttatagtggtgtaccccanatactacacaagactcggtagaacgggccgtatcacatcacagaagacaatccaaaggaacactatttagtatcttacaaattcgaaattaacccgtgaacgacgaccggaaggacgacggacctagtgtattacgtggtggtcgggggttacttacgtttaccgtccggaccccggttcggggggcccggggttaaaccccgtgggtacccctaacccggtcccctcccccgacccctcccgaacccgtaaccccgggg

SEQ ID NO: 418402 - DNA, 642 bp, Homo sapiens
  misc_feature: GZ8MTXP01DURW4.21.78.H01.1.454.CMB.2.raw
  modified_base (274)..(274): a, c, t, g, unknown or other
  modified_base (482)..(482): a, c, t, g, unknown or other
  modified_base (545)..(545): a, c, t, g, unknown or other
  modified_base (598)..(598): a, c, t, g, unknown or other
tcagtcgtcgctcgcacgaccggtgctcgatttagtgtgagtagtttgggtttggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccgtcgggggtccctgacgactctcctgtgctagtctcgtggttcnagtgcgactacatgagtcgtcgggtcccgcgaggctaccggaggggacggccgtaggagtggactctactaactttatttagtaggtggtacgtaaccccactatacctacacgaacgactcggtagggaaaccgggcctattaccacctatactacaagaaagacaaacttccgaaaggtaaacacgttattacgtaataccttaanaaatagaactaaacgtgaagacggacgagacgcgactagtagttactacgtggtaaggtcggnttaacgttcgttaccggcccgggttgggggaccccgggttaccgtggtacccncccggttcccacccccgttaccgtaacccgaaccggtaacccgg

SEQ ID NO: 418403 - DNA, 651 bp, Homo sapiens
  misc_feature: GZ8MTXP01BRALL.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgcaggctccgaggggaagggcctgggagtggatctactacttattagtaggtggtcggtaaccccactataacacacgaacgacctcggtagaacggggcctattccacatctacaagaacgactaattacccaggaaaccatattgtacttactaacaaatgaaactaaccgtggaacgacgaccgaggactaacggacctatagttaattacgtggtggttggggacttaacgtttacggtaccgtaacccccgggttggggggacccccggggttaaacccgttcggggtacccctaacccggttccccaccccccttaaccccgtcccgaacccggtaaaccccggg

SEQ ID NO: 418404 - DNA, 727 bp, Homo sapiens
  misc_feature: GZ8MTXP01BI2RR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgatccaggccgtcgggggtcctgagactctcctgtgcagtctgtgggttcgtcaggtggacgactacagtgagtcgtcgggtcccgcgtacggcctaccggaaggggaacgggccgtagggaggtgggtactccttactactttagtttagtaggtgggtacggtaaccccactaataacctacacgaaacgtacctccggtaggaaacggggccctaacttcacctatacctacgaaagaaacgaactaaacttaccgaaaggaaacctactaatttagtaacttcttaaacaaaagttagaaaacttaaaccgtggaaagaccggaccggaaggaccgtaccggactaagttagttaacttacgtggtaacggtggggttacttacttaccggttcccggaccccgggttacgggggttaccccgggttaacccgttcgggtacccctaaccccgggttcccctacccccgttaaccccgtcccgaacccggtaaccccggg

SEQ ID NO: 418405 - DNA, 753 bp, Homo sapiens
  misc_feature: GZ8MTXP01DE2GO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagtttggctgagcttgggttttccttgttgcttatttacaaaaggtgtccagtgtgaggtgcagttggtggagacgtgggaggaggcttgatccgaggccgtcgggggtccctgagctctcctgtgcagtctcgtggttcgtcgaggtggcgactacatggagcgtcggggtcccgccgaggccgtaccggaggggaacggggccgtagggagtggacttcttactaactttatttagtaggtggtacggtaaccccactatactacacaacgactcgagacgggcctataccacatctacaagaacgaacaacttaccgaaggtaaacactagtttacgtaacttacttaaactaaaatacgtaaacgttaaaccgtaggaaacggacggaaccggaaggaacccgaacgggtaccctaagtttacggttaaacgttacggttgggttcgggttacgggggttactttaaacggttttaccggttacccgggtaacccccgggggttaccggggggttacccccgggggttaaaccccggttccgggtaaccccgtaaccccggttacccccgtaccccccgttaccccgttaaccccgaacccgggtaacccccggg

SEQ ID NO: 418406 - DNA, 699 bp, Homo sapiens
  misc_feature: GZ8MTXP01AH93G.21.78.H01.1.454.CMB.2.raw
  modified_base (303)..(303): a, c, t, g, unknown or other
  modified_base (392)..(392): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtggtttctgtagctattcaaaggtgtcagtgtgaggtgcagttggtggagacgtgggaggaggcttgatccagccgtgggtggtcctgagtactctcctgtgcagtctcgtgggttctcgaggtcggcgaactacagtggacgcgtcgggcccncgacggctaccggaagggggacggccgtagggtagtcggacttccgtctaactttatttagtggtcgggtacgtaccatacttacctanaacgacgtaacctccgggtaggaacgggcctagttccaactatctacaagaacgaacaattacccgaaaggaactaacgtattacgtacttaccttaacaaagttacggaaactaaccgttagggaaccgaacggacccggaggaaccgtaaccggacctagttagtaacgtttagtggtggttacggggtactttaacgtttaccgtccgggttaccccgggttcggggggttaccccggaacccggttcggtaaccctaccccggtccccttaccccgtaaccccgttaaccccgtaaccccggg

SEQ ID NO: 418407 - DNA, 668 bp, Homo sapiens
  misc_feature: GZ8MTXP01EK7V3.21.78.H01.1.454.CMB.2.raw
  modified_base (336)..(336): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgctagttggtggagacgtgggaggaggcttgatccgagccgtggggggtccctgagactctcctgtgcagtctcgtgggttcgtcaggtggcgactacatgagcgtgggtccgcaggctcgagggaggctggagtggatctntacttatttataggtggtacgtacccactatactacacaacgactcccggagaaacgggccgtattccaaccatctacaagaaacgaactaacttcccaaggaaacctactatttagtaatctttaacaaattacgtaaacgtaaaccgtaggaacgacggaccggaggaaccgaccgggacctagtggttaacttacgtggtggtacgggggttactagtttttacccgtcggtaacccccgggttcgggggacccggggttaacccgtcgggtaccctccccgggtaccctaccccccgttaccccttccccgaacccgtaaccccgggg

SEQ ID NO: 418408 - DNA, 673 bp, Homo sapiens
  misc_feature: GZ8MTXP01CVKGQ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctgggacgtggatctcacttatttatagtggtcggtaccccacatactacacaagactccgtgaagggccgattcgacatctcagaacgacaattccaaggaacacgtattcgtatcttacaaaattcgaaattaaaccctggaacgacgacccgaaggaccacggggacccaagttacgttacgttaaccgttggtcgggttacgggggacctttaacgttttaccggttaccgggtacccccggttagggggggttccccggggggttaaaaccccttcgggggttaccccaacccggggtttcccctaccccccggttaacccctttcccgaaaccccggttaaaccccggggg

SEQ ID NO: 418409 - DNA, 638 bp, Homo sapiens
  misc_feature: GZ8MTXP01DPFQ0.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggagcttgatccgagccgtgggggtccctgagactctctgtgcagtctcgtgggttctcagtggcgactacatgagcgtcgggtcccgcgaggcgtccggaagggaacgggccgtggagtggattcctactactttagtttatagtggtcgtacccactatactacacaacgactcgtagaacgggccatcgacatctcaagaagactaactccgaaggaactactattagtacttactacaaatacgtaaactaaccgtgaaacgacgaccggaacgacgacggtacctaagttacgttaagttactgggtcgggtgggttcttacgttttacgtccggtaccccggttaccggggggcccgttaaccccgttcggtacccgtcccgttcccctacccccgaccgttccccgaaccgtaaccccggg

SEQ ID NO: 418410 - DNA, 695 bp, Homo sapiens
  misc_feature: GZ8MTXP01AC32D.21.78.H01.1.454.CMB.2.raw
  modified_base (342)..(342): a, c, t, g, unknown or other
  modified_base (359)..(359): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtggggttctcagtggcgactacatgagcgtgggtccgcaggcctccgaggggaggctggagtggatctctacttatttanaggtggtcgtaccccanatacgtacacaagactccggtagaaacggggcccgtattccaaccgtatacctacgaagaaacgaactaattacccgaaggaaaccactaattgtaacttacttaacaaattagaaactaaaccgtaggaagaacggaccggaaggaccgaaccgggacccaagttggttaaattaaccgtgggttaaggtcgggggttacttaacgttttaccgtaccgggtaacccccgggttcggggggccccgggggttaaaccccgttcgggggtacccctaaccccgggttccccgttaccccccacccccgttaacccgaaccccggtaaaccccgggg

SEQ ID NO: 418411 - DNA, 724 bp, Homo sapiens
  misc_feature: GZ8MTXP01CB5YB.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgactccgaggccgtgggggtccctgacgactctcctgtgcagtctcgtgggttcgtcgagtggcgactacatgagcgtcggtcccgacgaggcctcgaggggaaggccgtggagtggatctctactttattagtagtggtacgtacccacatactacacgaagacctcgtgaacgggccattccgacctatacctacaagaacgaactaaacttaccgaaacggtaaactacgtaatttcgtaacttacttaactaaaatacgtaaaactaaacccgttaggaaacgacggaccgaagggaaccgaaccgggacctaagttaggttaaaccttcggttgggttaagggtcgggggttacctttaaacgttttacccggtaccgggtaccccgggttccggggggggttaccccgggttaaaccccggttcgggtaccccgtaaccccgggttcccctaccccccgttaccccgttaaccccgaaaccggtaacccccgggg

SEQ ID NO: 418412 - DNA, 691 bp, Homo sapiens
  misc_feature: GZ8MTXP01C2CD8.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgagttgggtggagacgtggaggaggcttgatccagccgtgggggtccctgagactctcctgtgcagtctcgtgggttcgtcgagtggcgactacagtgagcgtcgggtccgccgaggcctccggaaggggaacgggcccgtagggagtgggacttcgtactactttatttataggtggttcgtaaccccactatactaacacaacgacgtcggtacggaaacgggtcctaattccgaacctatacctacgaaagaacgtaactaacttaccgaaaggaaacctaacgtaatttcgtaaacttacttaacaaaattacggtaaacttaaacccgtaggaacggaacggaccgaacggaaccgcggacctagttacgtattacgtggtaagggtgggcgttacttaccgtacggccccggttaggggggccccgttaaccggttcgggtaccctcccggtaccctcccccgacccgtccccgaaccggtaaccccggg

SEQ ID NO: 418413 - DNA, 649 bp, Homo sapiens
  misc_feature: GZ8MTXP01BNB9U.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtggtccgccaggctcgagggaggcctggagtggatcgtctactttatttataggtggtcggtacccacatactacacaagactccgtagaacggggcctattccacatctacaagaaagacaacttaccaaggaaacccatattagtacttacttaacaaatagaaactaacctgaacgagaccgaggacacggacctagtgttaattacgtggtggtacggggcttaacgtttaccgtccgggtaacccccgggttcggggggaccccgggttaaaccccggttcgggtaccccgtaaccccgttcccccggtaccccccttaccccgttccccgaaccccggtaaaccccgggg

SEQ ID NO: 418414 - DNA, 594 bp, Homo sapiens
  misc_feature: GZ8MTXP01D9294.21.78.H01.1.454.CMB.2.raw
  modified_base (170)..(170): a, c, t, g, unknown or other
  modified_base (246)..(246): a, c, t, g, unknown or other
  modified_base (248)..(248): a, c, t, g, unknown or other
  modified_base (263)..(263): a, c, t, g, unknown or other
  modified_base (265)..(265): a, c, t, g, unknown or other
  modified_base (267)..(267): a, c, t, g, unknown or other
  modified_base (269)..(269): a, c, t, g, unknown or other
  modified_base (271)..(272): a, c, t, g, unknown or other
  modified_base (274)..(274): a, c, t, g, unknown or other
  modified_base (300)..(300): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcgtggtttcgtgtagctattanaaaaggtgtcagtgtgaggtgcagtggtgagatggagaggctgatcgagccgtgggggtccctagagctctctgtncngtctgtggtcgtggngngngnanngngcgtcggcgcgacgcgcgaggagcgngagtgtatctactacttattagtagtgtacgtaccactataactacacaacgtacgtcgtacgacgtacgtactacactactacacaacaacaacactacgaacgaactaactaatactactactaactaaactaagtaacgtaacgtaacgacgacgacgacgacgacgtactatagtagtacgtgtggtacggttacgttacgttacgtaccggtaccgggttaccgggttccgggttaccgtccgtaccgtaacccgtcccgtacccgaccctaacccgaaccgtaacccg

SEQ ID NO: 418415 - DNA, 640 bp, Homo sapiens
  misc_feature: GZ8MTXP01EOSZ7.21.78.H01.1.454.CMB.2.raw
  modified_base (523)..(523): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgagactctcctgtgcagtctcgtgggttcgtcgaggtggcgactacagtgagcgtcgggtcccgccgaggcctccggaaggggacggccgtggagtggactctactactttatttagtaggtggtcgtaccccatatactacacaacgactcgtggaaacgggcacttacacatctacaagaacgactactacaaggaacctatattacgtactacttacaaattgaaactaactaggaacgacggacgaacggaacgacggcctaagtgtaactttacgngggttggtggggttacttacgtttaccgtcggtaccccgggttcgggggcccggttaacccgtcgggtcccgaacccgtccccttaccccgaccccttccccgaacggtaaccccgg

SEQ ID NO: 418416 - DNA, 722 bp, Homo sapiens
  misc_feature: GZ8MTXP01DUQE1.21.78.H01.1.454.CMB.2.raw
  modified_base (529)..(529): a, c, t, g, unknown or other
  modified_base (545)..(545): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagtttggctgagtcttgggttttccttgttgctatttacaaaaggtgtcagtgtgaggtgcgtagttggtggagacgtgggaggaggcttagactccgagtccggtgggggtcctgacgactctcgtgtcgctacgtcttcgtgggttcgtcgtaggtcggacgactacagtgagcgtcggccgacgaggcgtacggagggaacgggtccgtagggaggtggtacttcgtacttaacttttaatttagtaggtcggtacgtaaaccccaactaataacctaacacgtaaacgtaccgttccggtagggaaacgggtcctaacttaccaacctattaccgaacaaagaaacgaactaaactaccgaaagtaaacctatattagtaacttactaanaaaatcgaaactaacngaacgacgacgagaccacgactagtacgtattacgtgggtcgtggggttcctttaaagttcccggtaaccggtaccccggggttaccgggggttccccgggttaaacccgttcggtaccccgtccccttaccccgaccccccgttacccgtaacccgttaaccccggtaaccccggg

SEQ ID NO: 418417 - DNA, 584 bp, Homo sapiens
  misc_feature: GZ8MTXP01EAE9Y.21.78.H01.1.454.CMB.2.raw
  modified_base (297)..(297): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccnccaggctccgagggaagggcctggagtggatctcacttatttatagtggtggtaccccacatactacacaagactccgtagaaagggcccattcacatctcagaagacaattccaaggaaacacattgtatctacaaatgaaataacctgaacgacgccgaaggacacggaccatgtaattacctggtaagtggggctagttttacgtcggtaccccgttgggggcccggggttaaccctggggtccaaccggtccctcccccaacccgtccaacccgtaacccggg

SEQ ID NO: 418418 - DNA, 662 bp, Homo sapiens
  misc_feature: GZ8MTXP01APQ3I.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtcctgagactctctgtgcagtctcgtgggttctgagtggcgactacagtgacgcgtcgggtcccgcgaggccgtccggaggggaacgggccgtgggaggtggacttctactactttatttagagtggtacgtacccactatacctacacaaacgtacctcggagaacgggcaacttccacgattccacaaggaacaactaacttaccaaggtaaactactaatttcgtaaacttacttaacaaagttagaaacttaacgtaggaagaccggaccggaggaccacggctagtagttagtacgttgggtgtcggggttacttacgtttaccgtaccggtccccggggttgggggccccgggttaaccgtccgggtaccccgtccccgtcccgtacccccgaccctcccgaacccgggtaaccccggg

SEQ ID NO: 418419 - DNA, 667 bp, Homo sapiens
  misc_feature: GZ8MTXP01BDMEU.21.78.H01.1.454.CMB.2.raw
  modified_base (394)..(394): a, c, t, g, unknown or other
  modified_base (443)..(443): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgcttatttacaaaaggtgtccaggtgtgaggtgcgtaggttggtggagacgtgggaggaggtcttgactccgaggccggtcgggggtcctgacgtactctcctgtgctagtctcgtgggttcgtcgaggtggacgactacagtggagcgtcgggtcccgccgaggcctccggaggggacggccgtgggagtggactctactactttattagtggtggtacgtaccccanatacacacgaagtacctcggagaacgggcctactccacatcacgaaganaactattaccgaagaaactactagttacgtacttacttaactaaatacgtaaactacgtagaacgacggaccgaagaccgacgtacctagttagtacgttacgtggtcggtcgggttacttacgttaccgtacccgggtccccgggttacgggggcccgggttaacccgtcggtaccctccccgttcccgtacccccaccccgtcccgaacccggtaaccccgg

SEQ ID NO: 418420 - DNA, 706 bp, Homo sapiens
  misc_feature: GZ8MTXP01D8ZYI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgctagtctcgtgggttcgtcaggtggcgactacatgagcgtcgggtccgcaggctccgaggggaacgggcctggagtggactcgtactactttatttagtagtggtacgtacccactatactacacaacgactccggtagaaacgggccgtacttacacctattcctacaagaaacgaactaaacgttacccgaaaggtaaaactacgtaatttacgtaacttaccttaaacaaaagttacgtaaaacgttaaacccgttagggaaacgaacggaccggaaacgaccgtaaccggacctaagttggttaaactttacgtgggtaaggtgggggacttaaacgttttacgtaccgggaacccccgggttggggggaccccggggttaaacccttcggggtaccctaaccccggttcccctcccccgacccttcccgaacccggtaaccccgggg

SEQ ID NO: 418421 - DNA, 767 bp, Homo sapiens
  misc_feature: GZ8MTXP01AQ9MI.21.78.H01.1.454.CMB.2.raw
  modified_base (724)..(724): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctaggttggtggagacgtgggaggaggcttgatccgaggccggttcggggggtccctggacgtacctctccgtgtgctagtctcgtgggttcgtcgaggtcggacgactacagtggacgtcggtcgggtcccgaccgacggccgtaccggaaggggaacgggccgtaggggaggtcggtactccgttacttaacgtttagtttaagtaggttaggttacggtaaccccaactactaacctaacgacgtaacggaacccgtccgggtaaggaaacggggaccctacgtttaccaacctacgtacctacgaaagtaaacgaactaaacttacccgaaggtaaacacttaatttacgtaacttaccttaacaaaagttaacgaaacttaaacccgtaggaacgaaccggaccggaacggaaccgaccggtacctagtacgttaaacgttcggtagggtgggttcgggttactttacgtttcccggtaccggtaaccccggggttcgggggaccccggttaccgtcggtacccnccccgttccccacccccgttaccctccgaacccggtaacccgg

SEQ ID NO: 418422 - DNA, 650 bp, Homo sapiens
  misc_feature: GZ8MTXP01AVBK6.21.78.H01.1.454.CMB.2.raw
  modified_base (300)..(300): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtcctgacgactctcctgtgcagtctcgtgggttctcagtggcgactacatgagcgtgggtccncgaggcctccgagggacggctgggagtggatctctactttatttataggtggtcgtaaccccactatacacacaacgactcgagaacgggccattcacatctacagaaacgactaattcccgaaggtaaacactaagttacgtattctaacaaatagaaactacctgaacgacggaccgaagtaccacggacctagtagtaacttcgtaggtgggtcggggttacttaacgttttaccgtacgggtaccccggttacggggggttccccgggttaaacccgttcgggtaccccgaacccgttccccgtacccccgaaccccgttaaccccgaacccggtaaaccccgggg

SEQ ID NO: 418423 - DNA, 661 bp, Homo sapiens
  misc_feature: GZ8MTXP01BBUJF.21.78.H01.1.454.CMB.2.raw
  modified_base (413)..(413): a, c, t, g, unknown or other
  modified_base (419)..(419): a, c, t, g, unknown or other
  modified_base (442)..(442): a, c, t, g, unknown or other
  modified_base (453)..(453): a, c, t, g, unknown or other
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccaggctccggagggaacgggcctggagtggatctctactttattagtaggtggtcggtaaccccatatactacacaacgactccgaggaacgggccgtattcacatctanaagaanacaatccgaagaaacactagttntaactcttaanaaatagtaaactaacctaggaaggaacgacggaacggaaccacggaccttaagtacgttaattacgttggtgggtacgggttacttagtttacccgttcccgggaaccccgggttcggggggcccggggttaaccccgttggggtacccctaaccccgggttccccacccccgttaaccccgtccccgttaaacccggaaccccgggg

SEQ ID NO: 418424 - DNA, 710 bp, Homo sapiens
  misc_feature: GZ8MTXP01D9C7Q.21.78.H01.1.454.CMB.2.raw
  modified_base (458)..(458): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggacgactacatgagcgtcgggtccgccaggctaccgaggggaagggcctggagtggatctacgtactttatttagtagtggtacggtaaccccactataactacacaaacgacctccgtagaaacgggccgtattcaccatctacaagtaaagactaattcccgaaaggtaaacactaattntaacttcttaaacaaaattacgaaaacttaaacccgtagggaaacgaacggaccggaaacggaaccgaaccgggtaccaagttagttaaaccgtttacggtggttaagggttgggggttaccctaaagtttttaaaccgtcccggggtaacccccgggttacggggggggccccggggttaaaccccttcggggtaacccctcccggtcccctacccccggaccccttaacccgaacccgtaaaccccgggg

SEQ ID NO: 418425 - DNA, 614 bp, Homo sapiens
  misc_feature: GZ8MTXP01DTSBZ.21.78.H01.1.454.CMB.2.raw
  modified_base (421)..(421): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtcttcgtgggttcgtcaggtggcgactacatgacgcgtcgggtccgccaggccgtaccgagggacggccgtggagtggactctactactttatttagtagtggtacgtaccccactatactacacaacgactcgagacggccgtatccactatactacaagaanactaattaccaaggaacatattagtacttacttaacaaatagaaactaactgaacgacgccgaaggaccacgctagtgtacttacgtgtggtgggacttagttccgtaccggcccggttacgggggcccggttaacccgtcggtacccgtcccgtcccctcccccgttaccgtccccgaaccgtaaccccggg

SEQ ID NO: 418426 - DNA, 665 bp, Homo sapiens
  misc_feature: GZ8MTXP01EHOS8.21.78.H01.1.454.CMB.2.raw
  modified_base (288)..(288): a, c, t, g, unknown or other
  modified_base (305)..(305): a, c, t, g, unknown or other
  modified_base (544)..(544): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgacgactctcctgtgcagtctcgtgggttctcgagtggcgactanatgagcgtcgggtcccncgaggcctccgggaggggaacgggccgtgggaaggtggactctacgtactttagtttataaggtggtacggtaaccccactataacctacactaaacgacttcccgggagtaaacgggcccgtacttccaaccattacctacaaggaactaacaactccgaagtaaccatacttgtaatacttacaaatagaaacttaacgagaacgagaccggtagaaccgcgactatagtacttcgngtggtaggggttctaacgtttacgtcggtacccggttacggggttccgggttaacccgttcgggcccgtaaccccggttaccttacccccaaccccgttcccgaaacccggtaaccccggg

SEQ ID NO: 418427 - DNA, 684 bp, Homo sapiens
  misc_feature: GZ8MTXP01CCR73.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctcctgtgcagtctcgtgggttcgtcaggtggcgactacatggagcgtggtcccgcgaggccgtccggaggggacgggcctgggagtggatcgtactactttagtttagtaggttggtacggtaccccactatactacacaacgtacgtccgaggaaacgggccgtattaccgaacctactccgtaccaaagaaacgaacctaaacgttacccgaaaggtaaacctaactatttcgtaacttacttaacaaattacgaaacttaacgtagaagacgaccgaaggaccgacgacctagtcgttattcgtaggtcgggtagggttcttaacgttttacgtacggacccccgggttagggggaccccgggttacccgttccgggtccctaaccccggttcccaccccccgttaccctaaccgaaccccgtaacccggg

SEQ ID NO: 418428 - DNA, 729 bp, Homo sapiens
  misc_feature: GZ8MTXP01C6KCP.21.78.H01.1.454.CMB.2.raw
  modified_base (304)..(304): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtcgggggtccctgagactctcctgtgctagtctcgtgggttcgtcagtggcgactacatgagcgtcgggtcccncgaggcctcgaggggaggccgtggagtggatctactactttattagtagtggtacgtaccccatactactacacaacgacgtccgtaggaaacgggccctagttccaacatcctacgaaggaaacaactaacgttaccaagggaaactaacgtatttacgtaacttaccttaactaaaaagttcggtaaaaacttaaacccgttaggggaaaacggacgggaaccccggaacgggaacccggaaacgggtaccctaagttagggtttaacttacggtgggttaagggtacgggggactttaaccgttttacggtacccggtaccccggggttcggggggaccccggggttaacccgttccgggtaccctaaccccgggttcccacccccccgttacccgttaaccccgaacccgtaaccccgggg

SEQ ID NO: 418429 - DNA, 675 bp, Homo sapiens
  misc_feature: GZ8MTXP01BAY02.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctctgtgcagtctcgtgggttcgtcaggtggcgactacatgagcgtcgggtcccgccgaggcctaccggaggggaacgggccgtgggagtggatctactactttattataggtggtacgtaccccacatactacacgaagacctcgaggaacgggcctattccacatctacaagaacgaactaacttaccgaaaggaaacctactaagtttcgtaaattcctttaaacaaaattacggaaactaaccgtggaagacgaccggaaggaccaccggctagttacgtaagttacgtgggtaagggtcgggttcttaaacgttttccgtaccgggaacccccgggttggggggacccccgggttaacccttcgggggtaccccaaccccggttccccaccccccgaccccgttaaccgaaccccggtaacccggg

SEQ ID NO: 418430 - DNA, 769 bp, Homo sapiens
  misc_feature: GZ8MTXP01AQBV3.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgacgactctcctgtgctagtctcgtgggttcgtcgaggtggcgactacagtgagcgtcgggtcccgccgaggcctaccggaggggaaggggcctgggagtggatctctactttatttagtgtggtcgtaaccccactatacctacacgaacgaaccgtcgtaggaacggggacctagttccaccgtatcctacaagaacgaactaacgttaccgaaaggaaaccctacttaatttacggttaacttactttaaacgaaaaacgttaggtaaaaaccctaaacccggttaggaaacgggtaacgggaccccgggtaaacgggaaccgaacccggggtaccctaaagtttacggttaactttaacggttgggtaacgggttacgggggttactttaacggtttaccggttacccgggtacccccggggttacggggggttcccccggggttaaaccgttccgggtacccgaacccccggttccccgtacccccttaccccgttaaccccgaaacccgggtaaccccgggg

SEQ ID NO: 418431 - DNA, 713 bp, Homo sapiens
  misc_feature: GZ8MTXP01CBZ3K.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagacgtgggaggaggcttgatccgagtccgtcggggggtccctgacgactctccgtgtcgctgtctcgtgggttcgtcgaggtcggcgactacagtcggagcgtcgggtcccgcgacggccgtaccggaagggggaacggtccgtagggtaggtaggtacttctactacgttttagtttaacgtaggttcggtacggttaaccccccaacgtaacttaacctaacaaccaaacggtacccgtccggtagggaaccgggtacccgtacttccaacctatacctaccgaagaacgaactaaactaccgaaaggtaaacctacgtagtttacgtaacttacctttaaacaaacgtaacgtaaacgtacgtaggaacgaccggaccgaacgaccgacgtactagttagttacgtcgtggtcggtgttacttacgttcgtaccggtcccgggttccggggcccgttaccgtcgtccctcccgtccctccccaccctaaccgaaccgtaacccgg

SEQ ID NO: 418432 - DNA, 625 bp, Homo sapiens
  misc_feature: GZ8MTXP01ASBYC.21.78.H01.1.454.CMB.2.raw
  modified_base (415)..(415): a, c, t, g, unknown or other
  modified_base (461)..(461): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtcgggtccgccaggcgtccgaggggaacggcctggagtggatctcactttatttataggtggtagtaccccatatacctacacgaagactcggtagaaacggggccgacttcaccatcctanaagaaacgacaattccaaggtaaacactatttcgaattccttaaanaaatagtaaactaacgtagacgacgaccggaagacgacgactagtagttacttacgtggtaaggtcgggttacttacgttacgtcggacccggttacgggggacccggttaccgtcggtaccctaacccgtcccctaccccgaccctaacccgaaccgaaccgg

SEQ ID NO: 418433 - DNA, 797 bp, Homo sapiens
  misc_feature: GZ8MTXP01A6S2L.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctaggttggtggagacgtgggaggaggtcttgactccgaggccgtcgggggtcctgagtactctctgtgcagtctcgtggttcgcagtggcactacagtgagcgtcgggtcccgccgaggcctccggaggggacgggccgtgggagtggattctacttactttagtttagtaggttcggtacggtaccccactactaactacacaaacgacctcggtaggaacgggtaccgtacttaccacctactctacaaagtaaacgaacctaaacgttacccgaaaggtaaaccctaacttagtttaacgtaacttacttaaaccgtaaaagttacggtaaaacctttaacggtaacggggaaacgtacccgggaaacccgggaacggaacccggacccggtaaacccgttaagtttacggttaaacgtttaccggtggggtttaacggggtccggggttaactttaacggtttttaccccggggacccggttaaccccgggggttcggggggttaacccccgggttaacccggtttcccggaccccgttcccccggtccccgtaccccccgttaccccgtaacccggaaccccggtaaccccgggg

SEQ ID NO: 418434 - DNA, 754 bp, Homo sapiens
  misc_feature: GZ8MTXP01EE7Y6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgagactctcctgtgcagtctcgtgggttcgtcgagtggcgactacagtgacgcgtcgggtcccgcgaggcctaccggaggggaacggggccctagggaggtgggattccgtactaacttttagtttacgtaggtggtacggtaacccccacgtaactactaacaccgaaacgtacccgtccggtaggaaacggggccctaattccaacctatacctacgaagaaacgaactaacttacccgaaaggtaaacctaactaagtttagtaattacgttaacaaaatagaaacttaaccgtaggaagacgaccggaaggacccgaacggtaccctaagttcgttaacgtttaccgtgggttgggttacgggggttaccttaacgtttttacggtacccgggtaacccccggggttcggggggttccccggggttaaacccgttccggggtacccctaaccccgggttcccctaccccccgttaccccgttaaccccgaacccgtaaccccgggg

SEQ ID NO: 418435 - DNA, 652 bp, Homo sapiens
  misc_feature: GZ8MTXP01CG7RI.21.78.H01.1.454.CMB.2.raw
  modified_base (246)..(246): a, c, t, g, unknown or other
  modified_base (271)..(272): a, c, t, g, unknown or other
  modified_base (274)..(274): a, c, t, g, unknown or other
  modified_base (283)..(283): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagtttggctgagcgtggtttctgtgctattacaaaggtgtcagtgtgaggtgcagttggtggagactggaggaggcttgatcagccgtgggggtcctgagactctctgtgnagtctgtgggtctcagtggcactanngngcgtcggcncgagcacggagggacggcgtaggagtgactctatatttattagtaggtggtacgtaacccataataacaacaacgtaaacgtaccgtcggaacggaacgggtacctactaccaactatcaacaaagaaacaactaactaacgaacgaactaactaatacgttaacttacttaaactaaataaagtaaacgtaaacgtaagaacgaacgacggaacgaacgaacgtacgtaagtagttacgttacgtaggtggtacgggttacgttacgttacgttaccggtaccgggttaccgggggttaccggggttacccggtaaccgtaccgtaacccgtaccctaccccgacccctaacccgaacccgtaaccgg

SEQ ID NO: 418436 - DNA, 749 bp, Homo sapiens
  misc_feature: GZ8MTXP01AIPDX.21.78.H01.1.454.CMB.2.raw
  modified_base (278)..(278): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgctaggttggtggagacgtggaggaggcttgatccgagccgtgggggtccctgagactctcctgtgcagtctcgtgggttcgtnaggtgcgactacatgagcgtcgggtccgcgaggcctccggagggacgggcctggagtggatctactacttagtttagtaggtggtacgtacccactagtaactacacgaacgacgtccgtaggaaacgggccgtacttaccacctatctacaagaaacgaactaaacttacccgaaaggaaaccctacgtaatttacggtaaacttaccgtttaaacaaaacgttagtaaaaaccgttaaaccccgttgggaaacggtaaccggaacccgggaacgggtaacccggacccgggtaccctaagttacgttactttaaccggtgggttcgggtcgggggttactttaaacgtttacccgttaccgggtacccccggggttcgggggacccccggggttaccccgttggtacccccgtccccggttaccccctacccccgttaccccgtaacccgaaccccgggtaaccccggg

SEQ ID NO: 418437 - DNA, 776 bp, Homo sapiens
  misc_feature: GZ8MTXP01AVW9W.21.78.H01.1.454.CMB.2.raw
  modified_base (261)..(261): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtgggaggaggcttgactccgagccgtgggggtccctgagactctctgtgcngtctcgtgggttcgtcgaggtcggcgactacgagtggacgtcggtcgggtcccgccgaggcctaccggaggggacggccgtgggagtggtatctactacttatttagtaggtggtacgtacccactactactacacgaacgtaccgtccggtaggaaaccggggtcctacttaccaacctactacctaacgaagaaacgtaacctaaacttacccgaaacggtaaacctaacgttactttacgtaacttaccttaaacgaaaagttaacgaaaacgttaaacccgtaagggaaacgaaccgggaaccgggaacggtaaaccgaccggtaacctagttacggttaaacgttcggttggggtaacgggttacgggggttaccttaacggttttacccgggtaccggtacccccgggggttacgggggttacccccggggttaacccgttccggggtccctaacccccggtccccgttaccccccgaccccgttaaccccggaacccggaaccccggg

SEQ ID NO: 418438 - DNA, 659 bp, Homo sapiens
  misc_feature: GZ8MTXP01BF043.21.78.H01.1.454.CMB.2.raw
  modified_base (305)..(305): a, c, t, g, unknown or other
  modified_base (475)..(475): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgtcaggtggcgactacagtgagcgtcgggtccnccgaggcctaccggaggggaacgggtccgtgggaggtgggattcgtctactttagtttataggtggtacggtaccccacgatactacacaagacctcggtagaaacgggccattccacatctacaagaagaacacttacgaaggaaacactattacgtattaccttaaanaaattagaaacgtaacgtagacgacgacgaacggacgacgtactagttagttacttacgtggtggtcgggttacttacgtttaccggttaccggtaccccgggttcgggggttaccccgggttaccgtccggtacccgtccccgttacccctaccccgttaccctaacccgaacccggtaaccg

SEQ ID NO: 418439 - DNA, 755 bp, Homo sapiens
  misc_feature: GZ8MTXP01E2MEO.21.78.H01.1.454.CMB.2.raw
  modified_base (263)..(263): a, c, t, g, unknown or other
  modified_base (265)..(266): a, c, t, g, unknown or other
  modified_base (268)..(268): a, c, t, g, unknown or other
  modified_base (270)..(283): a, c, t, g, unknown or other
  modified_base (417)..(417): a, c, t, g, unknown or other
  modified_base (456)..(456): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgctgactcntnntntnnnnnnnnnnnnnntacgtacgtacggtacggtaccgtacgggtaccggtacccggtacgggtaccgggtacccggtaccgggggtaaccggggtacccggtacgttccccgtacgtctctctacgtaaccttactctactactactntactactactactactactactactactactactacacnctactacgtactactactactacgtaccgtaccgtacccgtaccgtacccgtacccgtacccgtacccgtaccccgtaaccccgttaccccgttaaccccgttaaccccgttaaccccgtttaacccccgttaacccccgttaaccccgttaaccccgttaaccccgttaaacccccgttaacccccgttaacccccgttaacccccgttaaccccgtaaaccccgtaaccccgttaaccccgttaaaccccgttaaaccccgttaaacccgtaaaccccgttaaaccccgtaaccccg

SEQ ID NO: 418440 - DNA, 692 bp, Homo sapiens
  misc_feature: GZ8MTXP01CH8IE.21.78.H01.1.454.CMB.2.raw
  modified_base (378)..(378): a, c, t, g, unknown or other
  modified_base (490)..(490): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcactacatggagcgtcgggtcccgccgaggcctaccggaaggggaacggggccgtgggagtgggattctctactttatttagtaggtggtcggtaccccanactactacacaacgactcgtaggaacgggccgtattaccgacctatcctacgaagtaaacgaactaacgttacccgaaaggtaactacgtaatttacgtaattacccttaanaaaattagaaaacttaaccgttaggaacgtaacgggaccgaacggaaccgaccggtacctagttagttacttacgtggttgggtacggggttcttaacgtttaccgttccgggacccccggttggggggccccggttaacccttcggggtccctaaccccggtcccctacccccgacccgtaacccaacccggtaacccggg

SEQ ID NO: 418441 - DNA, 684 bp, Homo sapiens
  misc_feature: GZ8MTXP01COPQJ.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgcgaggcctccgaaggggaacggccgtaggagtggattccgtactaactttatttagtaggttggtacggtaaccccacgtatacgtacacaacgtacctcggaggaacgggacctattccgacatcctacgaagaaacgtaacaagttacccgaaaggtaaactactaattcgtaatacttaacaaatagaaactaaccgtagaacgacgaaccggaagaccgaaccggactaagttgtaacttaccgtggttcgggtggggttacttaacgttttacgtaccgggtaccccgggttacggggggccccgggttaacccgtcgggtacccctaaccccggttccctaccccccgttacccgtaacccgaacccggtaaccccggg

SEQ ID NO: 418442 - DNA, 580 bp, Homo sapiens
  misc_feature: GZ8MTXP01E1MUF.21.78.H01.1.454.CMB.2.raw
  modified_base (368)..(368): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtggggtcccgccaggctcccgaggggaagggcctggagtggatctctactttatttataggtggtggtacccccanatactacacagactccgtagaacgggccattcacatctcagaagacaattccaggaacacattgtatcttacaaatgaaactaacctgagacgccgaggacacggccatgtattactgtggtggggctatttacgtcgaccccgttcgggggcccggggaaccctgggtccaacccggtccctcccccacccctcccgaacccgaacccggg

SEQ ID NO: 418443 - DNA, 781 bp, Homo sapiens
  misc_feature: GZ8MTXP01A8ML8.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgatccgagccgtgggggtccctgagactctcctgtgctagtctcgtgggttcgtcgaggtggcactacatgagcgtcgggtcccgcgaggcctaccggaggggaacgggtccgtagggagtgggtattccgttactaactttagtttagtaggttggtacggtaaccccacgtaatacctaacacgtaaacgaccgttccggtaggaaaccggggccctaacttccgaacctatacctacgaaagtaaacggaacctaaacgttacccgaaaggtaaaccctacttaagtttacgttaaacttaccttaaacgaaaagttacggtaaaaccttaacccgtaggaacggaacgggacccggaacggaacccgaacgggaccctaagttacggttaacttacggtgggttaagggttacgggggttaccttaacgttttaccgggtacccgggtaccccgggttacggggggccccggggttaaaccccgttcgggggtcccctaaccccgggtcccctacccccccgaccccgttccccgaaacccgggtaaccccggg

SEQ ID NO: 418444 - DNA, 826 bp, Homo sapiens
  misc_feature: GZ8MTXP01DL9QE.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctattcaaaaggtgtccagtgtgaggtgcagttggtggagacgtgggaggaggcttgatccagccgtgggggtccctgagactctcctgtgctagtctcgtggttcgtcgaggtggacgactacatgacgtcgtcgggtcccgcgaggccgtaccggaaggggaacgggcccgtagggtacggtgggattcccgttactaacgttttagttttaagtacggttaggtaccggtaaccccaacctaactaacccgtaaccaacgtaaacgtaacccgttccgggtaacgggaaaaccggggtaccctaaaactttacccaacccgtaactaccctaacgaaacgaaaacggtaaacctaaacgttacccgaaaacgggtaaaaccacttaagtttacgttaacttacccttaaactaaaaggttaacgtaaaaccgttaaacccgtaggaaacggaacccgggaaaccggaaccggaacccgaaccggaccttaacgttaggtttaaccgttacggttgggttaacgggtggggttaccttaacgttttaccgtacccgggtaccccgggttacggggggttccccggggttaaacccttcccggggtaacccctaacccggtccccctacccccacccgtaaccccgaacccggtaaccccgg

SEQ ID NO: 418445 - DNA, 659 bp, Homo sapiens
  misc_feature: GZ8MTXP01AT08C.21.78.H01.1.454.CMB.2.raw
  modified_base (177)..(177): a, c, t, g, unknown or other
  modified_base (282)..(282): a, c, t, g, unknown or other
  modified_base (389)..(389): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtntccagtgtgaggtgcagttggtggagactggaggagcttgatccagccgtgggggtccctgagactctcctgtgcagtctcgtgggttctcaggtggcgactacntgagcgtgggccgccaggctccgaggggacggctggagtggatctctacttattatagtggtcgtaccccacatactacacaagacctccgtgaacgggcattcacntcacagaagactaatccaaggaacactatttgtacttacttaacgaaattacggaaacttaaacccgtggaacggaacgacccggaacgggaaccgaccggacctaacgttgaaactttaccgtgggttaacgggtgggggttcccttaaacgttttccggtacccgggaaccccgggttcggggggaccccgggttaaccccgttcggggtccgtaacccccggttcccgtacccccaccccgtaacccgaaccccgggtaaccccggg

SEQ ID NO: 418446 - DNA, 744 bp, Homo sapiens
  misc_feature: GZ8MTXP01AU7EM.21.78.H01.1.454.CMB.2.raw
  modified_base (364)..(364): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgacgactctctgtgctagtctcgtgggttcgtcagtgcactacatgagcgtcgggtccgccgaggcctcgagggacggctggagtggactcgtactactttattagtagtggtacgtaccccanactactacacaagaccgtcggtagaacgggactacgttaccacctataccgtacaagaaacgtactaaacgttacccgaaaggtaaaccctaacgttatttacgtaaactttacctttaaaaccaaaagttaacgaaaaccggtttaaacccgtggaaacgggacccgtaaccgggaacggaaacccgaccgggtaacctaggtttaacgtacgtttaccggtagggttgggttaggggttacccttaacggttttaccgtcccggggtaacccccggggttacgggggttaccccggggttaaccccgttcggggttcccctaaccccgggttcccctaccccccgttaccccgttaacccgaacccggtaaccccggg

SEQ ID NO: 418447 - DNA, 695 bp, Homo sapiens
  misc_feature: GZ8MTXP01AWB2K.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtgggaggaggcttgactccgacgggcccgggggtcctgagacctctccgtgtgctagtctcgttgggttcgtcgaggtggacgactacagtgacgtcgtcgggtcccgccgaggccgtaccggaggggaacggccgtggagtggatctactacgtttattagtaggtggtacgtaacctactactactacacacgtaacctcggtaaggaacgggtacctacttaccacctagtacctacgaagaacgaactaacgttaccgaaaggaacctaacgtatttacgtaacttacgttaaactaaagtacgtaaactaaccggtgaacgacgaccgagaccgacggctagtagtacttacgtggttgggtcggtactttacgtttaccgttccgggacccggtacgggggttcccggggaccccgttacggtccgtacccctcccgtccccccacccgttacccgtaacccggaaccggtaacccccg

SEQ ID NO: 418448 - DNA, 615 bp, Homo sapiens
  misc_feature: GZ8MTXP01AH96X.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctctgggttcgtcagtggcgactacatgagctgggtccgcaggctcgaggggaaggcctggagtgggatctctacttattatagtggtaggtaccccatatacgtacacgaaagtaccgtccgtaggaacggggtccgatttccaacctaactcctacaagtaaagaacctaattaccgaaggaaaccataagttactattacttaacaaattacgaaactaacctagagacgaccgaaggacacggaccagtgtattacgtggtggtggggctacgtttacgtacgtacccgttcgggggcccggttaaccgtcggtccaaccgttcccaccccgaccctccgaacccgtaacccgg

SEQ ID NO: 418449 - DNA, 633 bp, Homo sapiens
  misc_feature: GZ8MTXP01C46AS.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtccgcaggcctccgagggacgggctggagtggatctctactttattagtaggtggtacggtaccccactatactacacaaacgactccggtagaaacggggcccattccactatctacagaagaacaattccgaaggaaacactattgtattcttaacaaatcgaaactaaacctgaaacgtacgaccgaagaccgacggtaccattcgtaattcgtggtaaggttcggggacttagttttaccgtcggtccccggttggggggcccgggttaaacccgtcggggtacccaacccgttcccggccccccaccgtaaccccgaaccggtaacccggg

SEQ ID NO: 418450 - DNA, 681 bp, Homo sapiens
  misc_feature: GZ8MTXP01DP94E.21.78.H01.1.454.CMB.2.raw
  modified_base (500)..(500): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagcgtcgggtccgccgaggcctaccgaggggaacgggccctgggacgtgggactcgttactacttttatttaagtaggtggtacggttaacccccactaataactaacaacaaacgtacctccggtagaaacggggtcctaattccaacctatcctacgaagaaagaacaacttacccaaggaaactaactaatttgtaattccttaaaanaaatagtaaactaacgtagacgacgacgaagacgacgactatagtacttacgtggtcggtggttacttacgtttacggtaccgggtaccccggggttacgggggttcccgggttacccgttcggtaccccgtaaccccgtcccctacccccgttacccgtaacccgaacccggtaaccggg

SEQ ID NO: 418451 - DNA, 679 bp, Homo sapiens
  misc_feature: GZ8MTXP01B4AME.21.78.H01.1.454.CMB.2.raw
  modified_base (260)..(260): a, c, t, g, unknown or other
  modified_base (306)..(306): a, c, t, g, unknown or other
  modified_base (637)..(637): a, c, t, g, unknown or other
  modified_base (649)..(649): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtggagacgtggaggaggcttgatccgagccgtgggggtccctgagactctcctgtgcngtctcgtggttcgtcaggtggcactacatggagtcgtcgggtcccncgaggcctccggaggggaacgggcctgggagtggactctctactttatttataggtggtcgtacccacatacacacaacgacctcggtaggaacgggccgtacttaccgaccattcctacgaagaaacgaactaactttaccaaagggtaaaccacgtaatttacgtaactaccgtttaaacaaagttacgaaaacttaacccgtaggaaacggacgcccggaaacggaccgacggaccctagttagtacgttacgtggtaaggtcgggttacttagtttaccgttcgggacccccggttcggggggacccgggaacccctgggtaccccnccccggttcccncccccgacccgtccccgaacggtaacccgg

SEQ ID NO: 418452 - DNA, 607 bp, Homo sapiens
  misc_feature: GZ8MTXP01A6N8B.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccgaaggggaaggggcccgtggagtggactctctacgtttatttagtaggtggtcggtaccccacgtataaccgtacacgaaacgaccgtccggtaggaaacgggcccgtagttccaccatcctacagaaacgacaaattcccaaggaaacactattgtatacttacaaatagaaataaccgtgaagacgacggagaccaggccaatcgtatacgtgtgtgggctagttcgtcgaccccggttcggggcccgggacctggtccaacccgtcctccccaccctccgaaccgtaaccggg

SEQ ID NO: 418453 - DNA, 665 bp, Homo sapiens
  misc_feature: GZ8MTXP01AWSN7.21.78.H01.1.454.CMB.2.raw
  modified_base (301)..(301): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagctgggtcccncaggctccgagggagggcctggagtggactctctactttatttagtaggtggtggtaaccccatataactacacaagacctccggtgaaacgggccgtattcaaccatctacaagaagactaattccaaggtaacactattacgattcttacaaaattcgaaattaacccgtgaagacggtaccgaaggaccacgggaccattggtaatttaccgtagggttcggtcgggggttacttaacgttttaccggtccggtaacccccgggttcggggggaccccgggggttaaacccttcggggtaccccgtaacccgtccccttaccccccgaccccgttaacccgaacccgttaaaccccggggg

SEQ ID NO: 418454 - DNA, 812 bp, Homo sapiens
  misc_feature: GZ8MTXP01B6LVN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcgttgggttttccttgttgcttatttacaaaggtgtccagtgtgaggtgcgtaggttggtggagacgtgggaggaggtctttgactccgacggtccggttcggggggttccctggacgtacttcctccgtgtcgctacgttcttcggtgggtttcgtcgtaggtcggcgaactacacgtgacgtcgtcgggtcccgccgacggccgtaccggaagggacgggtccgtagggtagtggtactttcgttacgttaacgttttaaagtttacgttaaggttcgggttaccggttaaccccctaacgtaacttaaccgttaaaccgaaccgtaaacgggttaaccctcgggttaacgggaaacgggggttaccctaactttaccaaccctagtaccttaaccgaaacggtaaaactaaactaaacgtttaccgaaaacggtaaacctaacgttaatttacgttaacttactaaacttaaagtaacgtaaacgttaacccgtaggaacgtacggaaccgaacggacgacggtaccattgttacttacgtgttaagggtcggttacttaactttcggtaccggtaacccgggttccgggggacccggttacccgttcgggtaccctaacccgttccccgaccccttacccggtccaacccggtaacccg

SEQ ID NO: 418455 - DNA, 709 bp, Homo sapiens
  misc_feature: GZ8MTXP01DQNE4.21.78.H01.1.454.CMB.2.raw
  modified_base (512)..(512): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcgagttggtggagacgtgggaggaggcttgatccgagcgtgggggtcctgagactctcctgtgctagtctcgtgggttcgtcgaggtggacgactacagtgacgcgtcgggtccgcgacggccgtaccggaagggggaacgggccgtagggaggtggtactccgttactaacttttaatttagtaggttggtacggtaaccccactaactactaacaacaaacgtactccggtaggaaacggggacctattccaactatacctacgaaagaaacaactaacttaccgaaaggaaactactattagtaactacttaanaaatacgtaaacgtaacgtaggaagacgacgaacggtacacggtacctattcgtaagttacgtggtggtacggggttacttaacgttttacggtacccgggaccccgggttacggggggccccgggttaaaccctcggggtaccccaacccgtttccccgacccccttacccgtccccgaaaccggtaaccccgggg

SEQ ID NO: 418456 - DNA, 691 bp, Homo sapiens
  misc_feature: GZ8MTXP01DDP4G.21.78.H01.1.454.CMB.2.raw
  modified_base (463)..(463): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcgagttggtggagacgtgggaggaggcttgatccgagccgtgggggtccctgagactctcctgtgcagtctcgtgggtcgtcagtggcgactacatgagcgtcggtccgcaggctcgagggacggccgtggagtggatctactactttattagtagtggtcgtaaccccatatacgtacacaacgacctcgtaggaaacggacctaaatccaccagtactacaagtaacgaactaactaccgaaaggaaactactattagtactacttaanaaaacgtgaaaactaaccgtaggaacgaacggacgaacggaaccgaacggacctaagttacgtaacgttaccgttgggtgggtacggggttcttaaacgtttacccggttccggaacccccggggttgggggttaccccggggttaaaccccgttcggggtacccctaacccgggttccccctacccccgttaaccccgtccccgttaaaccccggtaaaccccgggg

SEQ ID NO: 418457 - DNA, 661 bp, Homo sapiens
  misc_feature: GZ8MTXP01EOQM0.21.78.H01.1.454.CMB.2.raw
  modified_base (430)..(430): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgctagtcttcgtgggttcgtcgaggtggcgactacatggagtcgtgggtcccgccgaggcctccggaggggaacgggccgtgggagtggatcctactactttatttagtaggtggtacgtaccccatatactacacaacgactcggtagaacggccgtatcgacatctacaagaanacataccgaagaacactattgattacttaacaaagtcgaaactaactggaacgacgaccgaaggaccgacggacctaagttagttacgttacgtgggtaacggttcggggttactaacgttttaccgaccgggtaacccccgggttggggggaccccgggttaacccgttcgggtaccctaaccccggttcccacccccgttacccctaacccgaaacccggtaacccggg

SEQ ID NO: 418458 - DNA, 642 bp, Homo sapiens
  misc_feature: GZ8MTXP01AFQ5Q.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggttgagctgggttttccttgttgctatttcaaaaggtgtccagtgtgaggtgcagttggtggagacgtggaggaggcttgatccagccgtgggggtccctgagactctcctgtgctagtctcgttgggttcgtcaggtggcgactacagtgagccgtcggggtcccgccgacgggcctccggaagggggaacggcccgtagggagtggactctctaactttatttagtagtggtgtaccacatactacacagaactccggtgacgggccgattccactatctacaagtaaagactaacttccgaaggaaaccacgtaatttcgtaactaccttaacaaaagtgtaaaactaaccggtgaacggacgaccggaaggaccacggacctagtcgtaattacgtggtgggtaacgggcttacgtttacgttcggaaccccggtgggggacccgggttacccttgggtcccaccgtccctaccccaccgttaccaacgaaccgggccc

SEQ ID NO: 418459 - DNA, 668 bp, Homo sapiens
  misc_feature: GZ8MTXP01AK0EG.21.78.H01.1.454.CMB.2.raw
  modified_base (508)..(508): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgtcgagtcggcgactacttagtgagcgtcgggtcccgccgaggcctccgaggggaacgggcctgggagtggactcgtactactttatttagtagtggtacgtacccactatactacacaacgacctcggagacgggccgtatccacatctacaagaacgaacacttaccgaaggaacctacgtattacgtactacttaactaaatagaactaaacctggaagaccgacggtagaaccncgggactagtgttactaacgtggtaagtcggggttacttaactttcggtttcccgggaaccccgggttcggggggttccccggggttaaccccggtttcggtaccccgaaccccgttccccgtaccccccgacccccgttccgaaccccggaaccccggg

SEQ ID NO: 418460 - DNA, 720 bp, Homo sapiens
  misc_feature: GZ8MTXP01CASRM.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtcgggtcccgccgaggcctaccggaggggacgggccgtgggagtggatcctctactttatttagtaggtggtacggtaccccacactactacacaagacctccggtggaacgggccattccaccatcctacaagaacgaactaacttaccgaaggtaaaccactattagtacttacttaacaaagttagaaacttaacccgtaggaacgtacggacccggaagggacccaccgggcctaagttccgttaatttaccgtgggttaacgggttcgggggttacctttaaacgtttccgttacccgggtacccccggggttacggggggggcccccgggggttaaacccccgttcggggtacccccgtaacccccggtttcccctaccccccccgttaccccttaaccccggaaccccgtaaccccgggg

SEQ ID NO: 418461 - DNA, 655 bp, Homo sapiens
  misc_feature: GZ8MTXP01AP4Q8.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgagactctcctgtgcagtctcgttgggttcgtcaggtggcgactacatgagcgtgggtcccgccgaggcctccggaggggagggcctgggagtggatcgtctacttatttagtaggtggtcgtaccccacatacctacacaagacctcggtagaacgggcctattcaccatctacaagaagaactaacttccgaagaaaccactattacgtaacttacttaacaaattacggaaacttaaacccgtggaaacgacggaacccgaaggacgaccggactagttacgttattaccgtggtggtggggttactacgtttcgtaccggtccccgggttgggggcccgggttaacccgtggggtacccaaccccggttacccctcccccgttaccccgtcccgaacccgtaaccccggg

SEQ ID NO: 418462 - DNA, 599 bp, Homo sapiens
  misc_feature: GZ8MTXP01A3KKE.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcagtggcgactacatgagcgtgggtcccgccgaggcctccgaggggaacgggccgtggagtggatcgtactactttatttagtaggtggtcggtaccccatatactacacaacgacctcggtagaacgggcctattccacatctacaagaagacaatccgaaggaaacacgtattgtatacttacaaatagaactaactgaagacgaccgaggacacggcagtgtatcgtgtggtgggttctactttacgtcggacccggttcgggggcccggttaaccgtcgtcccgaacccgtccctcccccgaccctcccgaaccgtaacccggg

SEQ ID NO: 418463 - DNA, 677 bp, Homo sapiens
  misc_feature: GZ8MTXP01A0S1K.21.78.H01.1.454.CMB.2.raw
  modified_base (477)..(477): a, c, t, g, unknown or other
  modified_base (497)..(497): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtgggaggaggcttgatccgaggccgtgggggtcctgacgactctctgtgcagtctcgtgggttcgtcgagtggcgactacatgagcgtcgggccgcaggcctacggagggaacgggcctagggagtggatctactactttattagtagtggtacgtaaccccacatactaacacaacgtacctcggtaggaacgggcctattccaacctatcctagaacgaaagacctaattacccgaaaggtaacactagttctaattacctaaanaaattacgaaacttaaccgngaacgacggaccgaagaccacggactagtgttacttagtgggtggtacgggttcttaacgttttaccgtacccgggtaccccgggttacggggggccccggttaaccccgttcggggtaacccctccccgggtttaccccaccccccgttaaccccgtaacccgaacccggaaccccggg

SEQ ID NO: 418464 - DNA, 830 bp, Homo sapiens
  misc_feature: GZ8MTXP01AH4VN.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgacgactctctgtgctagtctcgtgggttctcgaggtggcgactacatgagcgtcgggtccgcgaggcctccggaaggggaacgggccgtagggacggtcggtacttccgttacgtaactttagttttaagtaggttcgggttacggtaaccccactaacttaaccgtaacacgtaaacgtacccgttccggtaagggaaaccgggggtccctactttaccaacctagttaccacgaaaggaaacgtaactaaactttacccgaaaggtaaacctaacgtaagttttacgtaaacttacccgtttaaaaacgtaaaacgttaacgtaaaaccggttaaaccgtagggaaaccgggtaaaccgggaacccgggaaacggtaacccggtaaccggtaaccttaaggtttaacgtttaacgtttacggttggggttaacggggttacgggttacctttaaaccggttttacccggttaccccggggtaaccccgggggttacggggggttaccccgggttaaccgttccgggtaccccgtaaccccggttaccccctacccccgttacccgtaacccgaaacccgggtaaccgg

SEQ ID NO: 418465 - DNA, 857 bp, Homo sapiens
  misc_feature: GZ8MTXP01EXJ27.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgttgggttttccttgttgctatttacaaaaggtgtccagtgtgaggtgcagttggtggagacgtgggaggaggtcttgactccgaggccggttcggggggtccctggacgtacctctccgtgtgctagttcttcgtgggttcgtcgaggtcggacgactacagtgacgtcgtcggtccgcgaggctaccggagggaacggcgtggagtggatcctacttactttagttagtaggtggtacgtaacccctaactactaacctaacaaccgtaaacgaccgttccggtagggaaacggggtccctaactttacccaacctattacccgtagaaaacggtaaacgaaaccttaaacgttaccccggaaaagggtaaaaacccctacgttttaaaggtttacgttaaacttaaccccgtttaaaactaaaaagttacggttaaaaaaccctaaacccggtttagggaaacggaacggaaccccgggtaagggaaacccctaacggggaccttaagttaagggtttatttaaccggtggggttaaggggttacggggttactttaaacggtttttcccgacccgggggtaacccccgggggttcggggggttacccccggggttaacccctttcgggggtaccccctaaccccgggtttcccccacccccccgttaaccccgttaacccgggaaacccggttaaccccccgggg

SEQ ID NO: 418466 - DNA, 604 bp, Homo sapiens
  misc_feature: GZ8MTXP01DG9F4.21.78.H01.1.454.CMB.2.raw
  modified_base (391)..(391): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagcgtcgggtccgcaggctcgagggaggcctggagtggatctcacttattatagtggtgtacccacatactacacaacgactcgagaacgggccatccacganctacagaagacaattaccaaggaacactattagtaactacttactaaatacgaaattaaacctagaacgacgaccgagacgacggaccatcgtattacgtggtgtgggggactactttacgttcggtaccccggttgggggccccgggttaacccgttcggtacccgtaacccgttcccacccccgaccccttcccgaacccgtaaccccggg

SEQ ID NO: 418467 - DNA, 736 bp, Homo sapiens
  misc_feature: GZ8MTXP01CWPSG.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagacgtgggaggaggcttgatccgagccggtcgggggtcctgagactctctgtgcagtctcgtgggttcgtcgaggtggcgactacatgacgcgtcgggtcccgcgaggccgtaccggaggggaacgggccgtgggaggtggtactctactactttatttagtaggtggtcgtaccccactatacacacgaacgacctcggtaggacgggcctacttaccactactactacaacgtaaacgactaaacgttacccgaaaggaaacctaacttagtttacgtaacttacttaaactaaaagttacgtaaacgttaaacccgtaggtaaacggaccggtaacccgggaacgggaacccgtaccgggtaacctagttacgttaacttacgtgggttaacgggtacggggttactttaaacgtttccggttacccgggtccccggggttaccggggggttccccgggaaccccgttcggtaccccgtaaccccgtccccaccccccttacccgtaaccccgaacccggtaaccccggg

SEQ ID NO: 418468 - DNA, 803 bp, Homo sapiens
  misc_feature: GZ8MTXP01BPNM8.21.78.H01.1.454.CMB.2.raw
  modified_base (592)..(592): a, c, t, g, unknown or other
tcagtcgtcgctcgcacgaccggtgctcgatttagtgtgagtagtttgggtttgggggggagaggtgcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtggaggaggcttgactccgagccgtcgggggtcctgacgactctcctgtgctagtctcgtgggttcgtcaggtggcgactacagtcgagcgtcgggtcccgaccgaggcctacccggaggggaacggggtcccgtggggaaggtcggtattcccgtttacgtaacttttagttttaagtaggttacggggtacgtaaacccccctaactaaacgttaaccttaaacccaacggtaaacggtaaccccgttcccgggtaacgggaaacgggggtaccctaaacgtttaccccaaaccctacgttaccctacgaaacgaaaacggtaacctaaacgtttacccaaaagggaaacccaacttaagtttacgtaaacttaccttaanaaaagttacgtaaaacgtaaaccgtaggaacggaacggaccgaacgaccgacggacctaagtacgttattacgtggttggtcgggttacttaacgtttaccggtacccggaccccgggttcggggggttaccccgggaaccccgttcgggtccctaaccccgttaccccgacccccccgttaccctaaccccgaaacccggtaaccccggg

SEQ ID NO: 418469 - DNA, 631 bp, Homo sapiens
  misc_feature: GZ8MTXP01BN1XC.21.78.H01.1.454.CMB.2.raw
  modified_base (533)..(533): a, c, t, g, unknown or other
  modified_base (604)..(604): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagcgtgggtcccgccgaggcctccgaggggaacgggcctggagtggatcgtctactttatttacgtagtggtacggtaccccactatactacacaagacctcgtaggaaacgggtcccgattcaaccgatcctacaaagaacgaacaaactttcccgaagggaaaccacgtaatttacgtattacttaacaaattagaaacttaaacccgtggaagacggccgaaggacacggaccatgtatttacgnggtgtggggactagtttacgtcggaccccggttgggggccccgggttaaccctgggtcccaacccgttccnccccacccgtccgaaccgtaacccggg

SEQ ID NO: 418470 - DNA, 622 bp, Homo sapiens
  misc_feature: GZ8MTXP01DRCM0.21.78.H01.1.454.CMB.2.raw
  modified_base (414)..(414): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccgtggggggtccctgagactctcctgtgcagtctcgtgggttcgtcaggtggcgactacatgagcgtgggtcccgcaggctccgagggaggccgtggagtggatcgtactactttatttagtagtggtcgtacccacatactacacaacgactcgagaacgggccattccgacatctacaagaanactaattccgaaggaaacactattgtaatctacaaattcgaaagtaacctggaacgacgaccgaaggacaccggacagtgtaatacgtggtggtggggttcctagttttaccgtaccgggccccggttcggggggccccgggttaacccgtggggtaccccaaccccggttcctcccccccgaccttccccgaacccgtaacccgggg

SEQ ID NO: 418471 - DNA, 637 bp, Homo sapiens
  misc_feature: GZ8MTXP01AEARD.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcgaggcctccggaggggaacgggccgtggagtggatcgtactactttatttagtagtggtcgtacccacatactacacagactcgtgaacgggcatcacatcctacaagaagactaacgttccaaggaacactattgtaactcttaacaaatagaaactaactggaagacggaccgaaggaccacggaccctaagttcgtaaattacgttggtcggtggggttactaacgttccgttacggacccccgggttcgggggaccccggggttaaccgttccgggtccctaaccccggttcccctacccccttaccccgtccccgaacccggtaacccggg

SEQ ID NO: 418472 - DNA, 654 bp, Homo sapiens
  misc_feature: GZ8MTXP01AS3H9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtggagacgtggaggaggcttgatccgagccgtgggggtccctgagactctcctgtgctagtcttcgtgggttcgtcgaggtggcgactacatgagcgtcgggtccgccgaggcctcggaggggacggccgtggagtggatctactactttatttagtgtggtacgtacccactatactacacgaagacctccggtaggaacgggcctacgttcacctatacctacgaagaaacgaactaaacgttaccgaaggtaaacacgttatttacgtaattacttaaacaaataacgtaaacgttaaccgtaggaacggacggacggaacggacaccggtacattacgttatcgtggtcgggtgggttacttacgtttcgtcggaccccggttgggggccccgggttaacctgggaccctcccgtccctaccccgaccctccgaacccggtaacccgg

SEQ ID NO: 418473 - DNA, 670 bp, Homo sapiens
  misc_feature: GZ8MTXP01ARAHO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgatccgagccgtgggggtccctgacgactctcctgtgcagtctcgtgggttcgtcgaggtggcgactacatgagcgtcgggtccgccgaggcctccgaggggaacggccgtggagtggatctactactttatttagtaggtggtacgtaccccactatacgtacacaacgactcggagaacgggccgattccgacactctacaagaacacaataccagtaacactattgtactacttaacaaatagaaactacgtaggaagacggccgaaggaccacgggtacctagttagtaagttcgtggttaacgggtcggggttacctttaacggtttccgttacccgggtaccccgggttcggggggttaccccgggttaacccgttccggtacccctaacccgttccccgacccccccttacccgtaacccgttaacccgtaaccccgggg

SEQ ID NO: 418474 - DNA, 727 bp, Homo sapiens
  misc_feature: GZ8MTXP01AIE0P.21.78.H01.1.454.CMB.2.raw
  modified_base (393)..(393): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggtcttgactccgagtccgttggggggtccctgagtaccttctccgtgtgctagtctcgttgggttcgtcgaggtggcgactacagtggagcgtcgggtcccgccgaggcctcggaggggaacgggcctgggagtggactctactactttattagtaggtcggtacggtaaccccanatacaccacgtaacgacctccggtaggaaacggggccctaagttaccaacctattaccgtacaaaggaaacgaactaaacgttccgaaaggaaactactatttacgtactacgttaacaaatagtaaactaaaccgtggacgaacgaccggaagaccgacggtacctaagttcgtaactttacgtgggtgggttacggggttacttaacggtttaccgtcccgggtaacccccgggttcggggggacccccgggttaaaccccgttcgggtaaccccgtccccgggttcccctaccccccgttacccgtaaccccgaacccggtaaccccgggg

SEQ ID NO: 418475 - DNA, 561 bp, Homo sapiens
  misc_feature: GZ8MTXP01D2MA1.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagtttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgagggagggcctggagtggatctctactttatttatagtggtggtaccccacatactacacaagactccgtgaagggccattcaccatctcagaagacaattccgaagaacactattgtatcttacaaatgaaattaacctgaacgagccgaggacacggccatgtatacgtgtgtgggctagtttcgtcgaccccgttgggggcccgggaccctggtcccaacccgtctcccccacctcccgaaccgtaaccggg

SEQ ID NO: 418476 - DNA, 754 bp, Homo sapiens
  misc_feature: GZ8MTXP01BHBYO.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcgaggttggtggagacgtgggaggaggcttgatccgaggtccggtcggggggtccctggacgtactctccgtgtgcagtctcgtgggttcgtcgaggtggcgactacgatggacgcgtcgggtcccgccgaggccgtaccggaggggacgggccgtggagtggactctactactttatttagtaggttcggtacgtaaccccactatactaacacgtaacgtaccgtcggtacggaacgggtccgtacttaccgaacctactacctacgaagtaaacgaacctaaacgttacccgaaggtaaaccacttaagtttacgtacttaacttaacgaaaattacggtaaaacttaaaccgtgggaacgaaccgggaccggaacggaacccgtacgggacctaagtcgttaacgtttacgtggggtaaggtcggggttacttaacgtttaccggtaccgggtacccccgggttcggggggttaccccgggttaaccccgttcgggtaccccgtaaccccggttcccctacccccccgttaaccctccccgaacccggtaaccccggg

SEQ ID NO: 418477 - DNA, 720 bp, Homo sapiens
  misc_feature: GZ8MTXP01DUJKA.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagactgggaggaggcttgatccgagtccgtgggggtccctgagactctctgtgcagtctcgtgggttcgtcaggtggcgactacatggacgcgtcgggtcccgccgaggccgtcccggaaggggaacggggtcccgtagggaagtgggtattcccttactaacctttagttttacgtaggtggtacggtacccccactaactaccgtacacgtaacgaccttccggtagaacggggccctatttacccgactatactacaagaaacgtaacaacttaccgaaggtaaacactattacgtacttacttaactaaagtacgtaaacgtaaccttggaaacgtacgaccggaacgaaccgaccggtaacctaagttagttaacttaaccgtgggtgggttcggggttacttaacgttttacgtccggtaaccccgggttcgggggttacccgggttaccccgtcggtaccctaacccgtcccctacccccgaccccgttcccgaacccggtaacccggg

SEQ ID NO: 418478 - DNA, 682 bp, Homo sapiens
  misc_feature: GZ8MTXP01BUFNS.21.78.H01.1.454.CMB.2.raw
  modified_base (319)..(319): a, c, t, g, unknown or other
  modified_base (330)..(330): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcgagtggcgactacatgagcgtggtcccgcgaggctcgagggaggccnggagtgatctntacttattagtagtggtcgtacccatatactacacgaacgacctccggtaggaaacgggcccgtattccgaaccactctacgaagaaacgactaagttacccgaaggaaaacctactaagtttacgttaattaccttaaacaaaagttacggaaaacttaacccgtaggaaccgacggtacccggaacggaccgaccggtacctagttagttaacgtttacgtggtcgggtcggggttacttaacgtttcgtaccgggaccccggttcggggggaccccggttaacccgtcggttaccccgaacccgttccccgtacccccgaccccgttaacccgaaccggtaaccccggg

SEQ ID NO: 418479 - DNA, 691 bp, Homo sapiens
  misc_feature: GZ8MTXP01CAWX9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgactccgaggccgtgggggtccctgagactctcctgtgcagtctcgtggttcgtcagtcggcgactacatggagtcgtcgggtcccgcgaggccgtaccggaaggggaacggtccgtagggagtggtacttcgtactaacgtttatttagtaggtcggtacgtaacccccactaagtacctaacacgaaagtacccgtccggagggaaacgggccctacgttaccacctactactacgaaacgaacgaactaacttacccgaaaggaaacctactattcgtaacttacttaacaaatacgaataaaccgtgaacgtacgacgaaggaccacggcctagtagttaacttcgtggtcggtgggttacttacgtttaccgtccggtaccccggttcgggggcccggttaacccgtgggtacccctaacccgttcccctacccccgccccgtaaccgttaacccgaacccggg

SEQ ID NO: 418480 - DNA, 599 bp, Homo sapiens
  misc_feature: GZ8MTXP01CLRRW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagccgtggggggtccctgagactctcctgtgcagtctctgggttcgtcaggtggcgactacatgagcgtggggtcccgccaggctcccgaggggaagggcctggagtgggatctcactttatttatagtggtggtaccccacgatactacacaagacctccggtgaaaggggccattcaccatctcagaagacaattccaggaacactattagtactcttacaaatgaaataaccgtgagacgaccgagacgacggaccatgtattacgtgtaaggtggggcttagtttacgttcggccccgttcgggggcccggggttaacccgtcgggtcctaacccggtccctcccccgacccgtcccgaaccgtaacccggg

SEQ ID NO: 418481 - DNA, 619 bp, Homo sapiens
  misc_feature: GZ8MTXP01BPVJV.21.78.H01.1.454.CMB.2.raw
  modified_base (398)..(398): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcgaggtggcgactacagtgagcgtgggtcccgcaggcctaccgaggggaggcctgggagtggatctgtactttatttatagtggtacgtacccacatactacacaacgactcgagacgggcattccacgntctacaagaagacaacttccaagaaactactattcgtattcttaacaaattgaaacgttaaccgtagtacgacgaccgacggaccgacggacctagtagttattacgtggtggtggggttcttacgtttcgtccggtaacccggttcgggggcccgggttaacccgtcgggtcccgtaacccgttcccctacccccgaccctcccgaacccgtaacccggg

SEQ ID NO: 418482 - DNA, 632 bp, Homo sapiens
  misc_feature: GZ8MTXP01ESAGV.21.78.H01.1.454.CMB.2.raw
  modified_base (304)..(304): a, c, t, g, unknown or other
  modified_base (417)..(417): a, c, t, g, unknown or other
  modified_base (458)..(458): a, c, t, g, unknown or other
  modified_base (464)..(464): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtgggaggaggcttgatccagccgtgggggtccctgagactctctgtgcagtctcgtgggttcgtcagtggcgactacagtgagcgtgggtccnccgaggcctccggagggaaggcctggagtggatctactactttatttagtaggtggtacgtaccccatatactacacaacgactcggtagaacgggccgtatccacatcctanacaagactaataccaaggaaaccagtattgtatccttaaanaaatanaacgtacgagacgacgacgacgacgacgactagtagtacttacgtggtcgggtcggttacttacgtttaccggtaccgggtacccggggttaccgggggacccgggttacccgtcggtaccctaacccgtcccctacccccgacccgtaaccccgaaccggtaaccgg

SEQ ID NO: 418483 - DNA, 778 bp, Homo sapiens
  misc_feature: GZ8MTXP01BUF23.21.78.H01.1.454.CMB.2.raw
  modified_base (288)..(288): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattacaaaaggtgtccagtgtgaggtgcagttggtggagacgtgggaggaggcttgatccaggccgtgggggtccctgagactctctgtgcagtctcgtgggttcgtcaggtggcgactacntggagcgtcgggtcccgcaggcctccggaagggacggggcctgggacgtggactcctactaactttatttagtaggtcggtcgtaaccccactacgtactaaccacaaacgtcctccgggtaggaaacggggccctaacttccaacctatacctacaaacggaaacgtaaactaaacgttacccgaaacgggtaaaacctacttaacgtttacgttaactttaccttaaactaaaattacggtaaaacttaaacccgttaaggaacggtaacgacccgggaaaggaacccgacgggtaaccctaagttacggttaactttaaccgtggggttaacggttacgggggttactttaaccggttttaaccggttaccgggtaacccccggggttcggggggacccccgggggttacccggttaaccgggtaccccgtaaccccggttccccgtaccccccaccccgttaaccccgaacccggtaaaccccggg

SEQ ID NO: 418484 - DNA, 647 bp, Homo sapiens
  misc_feature: GZ8MTXP01DTTT7.21.78.H01.1.454.CMB.2.raw
  modified_base (294)..(294): a, c, t, g, unknown or other
  modified_base (525)..(525): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagtggtggagactggaggaggcttgatccagccgtgggggtccctgagactctcctgtgcagtctctgggttcgtcagtggcgactacattagctgggtccnccgaggctccgaggggacggcctggagtggatctctacttatttatagtggtgacctacatactacacacgtaactccgtggaaacgggtcccgtattccgaccctataccgtacaacgaaagaacaacttaccgaaggtaaacaactattagtaactacttaacaaattagaaacttaaccgtagaaggaacgaccgaaggaacacggacctaagttgttaactttacgnggttggtaaggggtacttagtttaccgttcggtaccccggtgggggaccccgggggttacccttacgggtccgaaccccggtccttcccccgacccgttaccctaaccgaaccgggtccccg

SEQ ID NO: 418485 - DNA, 804 bp, Homo sapiens
  misc_feature: GZ8MTXP01AIN3Q.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctcctgtgcagtctcgtgggttcgtcgagtcggcgactacatgacgcgtcgggtcccgccgacggccgtaccggaaggggaacgggccgtgggaggtaggtactcgttactaacgtttagtttagtaggttcgggtacggtaacccccaacgtactaacctaacacgaaacgtaccgttcccggtagggaaaccggggtccctaacgttaccaacctacttacccgtaaccgaaagaaaccgtaaactaaacgtttaccccgaaagggtaaaccctacgttaagtttacgttaaactttaccgttaaacaaaagttaacggaaacttaaacccgtagggaacggaaccggaacccggaacgggacccgaaccggtaccctaagttcggttaacgtttacggtagggttgggtacggggttactttaaccgttttaccgttacccgggacccccggggttcggggggcccccgggttaaacccgtccgggttacccctaaccccgggttcccctacccccccgttacccgtccccgaaacccgggtaacccccggg

SEQ ID NO: 418486 - DNA, 626 bp, Homo sapiens
  misc_feature: GZ8MTXP01BEQIM.21.78.H01.1.454.CMB.2.raw
  modified_base (385)..(385): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgccgaggctccgagggacggccgtggagtggatctctacttatttagtagtggtcgtaccccacatacgtacacgaacgacctcgnggaaacgggcctattccgacatctacgaagaagacaattccaaggaacactattgtatacttacgaaatagaactaacgtggaacgacgacgaacgacgacggaccaagttcgtacttacgtggtggttcggggttactacgttttacgtccggtaccccgggttcggggggcccgggttaacccgtcggggtcctaaccccggtccctacccccacccgtcccgaaccggtaaccccggg

SEQ ID NO: 418487 - DNA, 669 bp, Homo sapiens
  misc_feature: GZ8MTXP01CSTOX.21.78.H01.1.454.CMB.2.raw
  modified_base (442)..(442): a, c, t, g, unknown or other
  modified_base (497)..(497): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgcttatttacaaaaggtgtccagtgtgaggtgcgtaggttggtggagacgtgggaggaggtcttgactccgacggtccggtcgggggtccctggacgtactcctccgtgtgctagtcgttcgttgggttcgtgaggtcggcgactacagtgacgtcgtcgggtccgcgaggcctacggaagggacggctggagtggatctactactttattagtaggtggtacgtacccatatactacacaacgtaccgtcggtagaacgggtactactccactactcanaaagaacgtaactaacgtaccgaaagtaactacgttattactacttaccttaaanaaattaagtaaacgttaacgtaggaaacgacggaccgaacgaacgaccgtactaagttgttacgttacgtgggtaacggttcgggactttacgttcgtccgggacccgggttcgggggcccgttaaccgtcgaccctccgtccccaccccgacctccgaacccggtaacccg

SEQ ID NO: 418488 - DNA, 711 bp, Homo sapiens
  misc_feature: GZ8MTXP01EA86K.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggtagttttggctgagcttgggttttccttgttgcttatttacaaaaggtgtccagtgtgaggtgcgtagttggtggagacgtgggaggaggtcttgatccgagccgtgggggtccctgacgactctctgtgcagtctcgtggttcgcaggtggcgactacagttgacgtccggtcgggtcccgccgaggccgtaccgggaaggggtaacggggcccgtagggacggttaggtacttccgttactacgttttaagtttagttaggtcggtacgtaacccccaactaactaactaccaactaacgactcggtaggaacgggtcctactccacatctacaagaacaacaaacttaccgaaagtaaaccacttattacgtaacttactaactaaagtagtaaaacgtaacgtagaacgacggaccggaacgaccgacggtacctagttcgtaagttacgtggttggtacgggttcttaaccgttttcggaccggtcccgggttacgggggttcccggttaaacccgttcgggtaccctaacccgtcccctacccccgaccctaaccccgaaccggtaaccccgg

SEQ ID NO: 418489 - DNA, 615 bp, Homo sapiens
  misc_feature: GZ8MTXP01COLVQ.21.78.H01.1.454.CMB.2.raw
  modified_base (367)..(367): a, c, t, g, unknown or other
  modified_base (511)..(511): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgaggtcggcgactacagtgagcgtcgggtccgcgaggcgtccggaaggggaacggctggagtgatctacactttattataggtgtcgtaccccanatacacacaagactcgagaacgggccgtactcactatcacaagaagactaataccaaaggactaacgtattagtactactaacaaaatagaaactaaaccgtagaagaccgacgaagaccacggactagtacgtaagttaccgnggtaaggtacgggcttaaacgttccgtacgggaccccgttggggggaccccggttaacttcgacccgtcctccccgcccttaccccgtccgaaccgtaacccgg

SEQ ID NO: 418490 - DNA, 672 bp, Homo sapiens
  misc_feature: GZ8MTXP01AJ87J.21.78.H01.1.454.CMB.2.raw
  modified_base (371)..(371): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggtttttccttgttgctatttcaaaaggtgtccagtgtgaggtgcagttggtggagacgtggaggaggcttgatccgagccgtgggggtccctgagtactctcctgtcgcagtctcgtgggttcgtcgaggtggcgactacagtggacgcgtcgggtccgcgaggcctcggaggggacggcgtggagtggatctactactttattagtgtggtacgtacccanatacacacaagccgtcggtaggaacgggcctacgttccacgtattcacgaaagaacgactaaacgttccgaaaggaaccctataagttcgtaacttacttaactaaaagttacgaaacgttaaccgtagggaacgaacggaccggaacggaaccaccgggtacctagttacgtacttacgtgggtcggtacgggttcttacgtttccggtaccgggccccgggttcgggggaccccggttacccgtcggtaccccgccccgttccccgaccccttaccccgtcccggaaccgaaccccggg

SEQ ID NO: 418491 - DNA, 797 bp, Homo sapiens
  misc_feature: GZ8MTXP01DHPFW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagtcttgggttttccttgttgcttatttacgaaaaggtgtccagtgtgaggtgcgtagttggtggagacgtgggaggagtcttgactccgacggtccggtcgggggtccctgacgtacttcctccgtgtgctagtcttcgtgggttcgtcgaggtggacactacagtgagtcggtcggtcccgacgacggccgtaccggaaggggaacggtcgtaggtaaggtggtacttcgttacttagttttaagtttagtaggtcggttacgtaacccacgtaactactaaccgaacgtaacgtaccgtccggtaagggaaccgggtaccttaacgtaccccaactacgtacctaacgaaagtaaaccgtaacgtaaaccgttacccgaaaaggtaaacttaaacgttagttttaacgttaacttacgttaaacgtaaataacggtaaacgttaacccgtaggtaaacgaccgggaccgaaacggacccgtacggaaccttaattggtttaaaccttgtaggtcgggttacgggttactttaaccggttacggttaccccgggtacccgggttacccgggggttcccggttaaccgttcccggttaccccgtaacccgtcccccgtacccttaccccgtaacccgaacccgtaaccccggg

SEQ ID NO: 418492 - DNA, 798 bp, Homo sapiens
  misc_feature: GZ8MTXP01D0KFH.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactgggaggaggcttgatccagccgtgggggtccctgagactctcctgtgcagtctcgtgggttcgtcagtggcgactacatgagcgtggtccgcaggctccgagggaggcctggagtgatctctacttatttagtagtggtacgtaccccatactaacgtacacgaacgacctccggtaggaaacgggtcccgaactttcccaacctattacctaccgaaaggtaaacgaaactaaacttacccgaaagggaaacctacgttaactttcgtaaacttacttaactaaaattaggtaaaacttaaacccgttggaaacggtaaacggacccgggaaacgggaacccggaaccggtaaccccgtaagtttacgggtttaaacgtttaaccggttgggttaaggggttcggggggttaacctttaaacggttttttaacccggttaacccggggtaaccccccgggggttcggggggggttaacccccgggggttaaacccccgttccgggggttacccctaaacccccggggtttccccctaccccccccggttacccccgttaaccccgaaaccccgggtaaacccccgggg

SEQ ID NO: 418493 - DNA, 726 bp, Homo sapiens
  misc_feature: GZ8MTXP01EK8Y2.21.78.H01.1.454.CMB.2.raw
  modified_base (268)..(268): a, c, t, g, unknown or other
  modified_base (540)..(540): a, c, t, g, unknown or other
  modified_base (548)..(548): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagtcttgggttttccttgttgcttatttacaaaaggtgtccagtgtgaggtgcgtaggttggtggagacgtgggaggaggcttgactccgacgccggtcgggggtcctgagactctctgtgcngtctcgtggttcgtcaggtcggacgactacagtgacgtcgtcgggtcccgaccgacggcctacggaggggaacggccgtaggagtggacttcttactaacttttagtttacgttaggttacggtacggtaacccctaacgtaacttaacctaacgaactaacggtaacccgtcggtagggaaacgggacccgtacttaccacctaactctacaaacgaaacgtaactaactaccggtaaacgaaaccactttatacgttaacttaccttaanaaagtaanaaacgtaacgtaaggagtacggacgaacgaccacggtacctagtagttacttcgtaaggtggtacggttacttaacgtttcgtaccgggtcccgggttccgggggttacccggttacccgttcggtaccccaaccgttccccaccccgttaccctaacccgaacccggtaaccccggg

SEQ ID NO: 418494 - DNA, 696 bp, Homo sapiens
  misc_feature: GZ8MTXP01AJMOO.21.78.H01.1.454.CMB.2.raw
  modified_base (553)..(553): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtcctgagactctctgtgcagtctcgtgggttcgtcagtggcgactacatgagcgtcgggtccgcgaggcctccggaggggaacgggcctgggagtggatctcgtactttatttagtaggtggtacggtaccccactataactacaacaagacccgtcggtagaacgggccctattcaccacttcacgaagaacgaactaacgttacccgaaggtaaacctacgtatttacgtaattaccttaacaaaattcggtaaaactaaccggtagacgtaacgggaccgaacggacaccgggacctagtacgttacttacggnggttgggtacggggttaccttaacggttttaccgtaccgggtaacccccggggttcggggggaccccggggttaaccctcgggtaccccgtaacccgttccccttacccccaccccgttaacccgaacccggaaaccccgggg

SEQ ID NO: 418495 - DNA, 607 bp, Homo sapiens
  misc_feature: GZ8MTXP01BOBJO.21.78.H01.1.454.CMB.2.raw
  modified_base (365)..(365): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtcttcgtgggttcgtcaggtggcgactacatgagcgtcgggtccgcgaggctccgaggggaacgggccgtggagtggatctctactttattatggtggtggtacccanatactacacaacgactcgaggaacgggccattcactatctcaagaagacaattccaaggaacactattagtatctacaaatgaaactactggagacgcgaagacgacgacagtgtatcgtggtaaggtcggggttctacgtttacgtccggaccccgggttcgggggaccccgggttaacccgtcggggtaccctaaccccggtccctaccccgacccctaacccgaacccggtaacccggg

SEQ ID NO: 418496 - DNA, 733 bp, Homo sapiens
  misc_feature: GZ8MTXP01CT749.21.78.H01.1.454.CMB.2.raw
  modified_base (517)..(517): a, c, t, g, unknown or other
  modified_base (629)..(629): a, c, t, g, unknown or other
  modified_base (648)..(648): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagtcgttgggttttccttgttgcttattacaaaaggtgtccagtgtgaggtgcgtaggttggtggagacgtgggaggaggtcttgactccgacggtccggttcggggggtccctaggtacgtaccttccgtccgtgtcgcgtacggttcgttcggttcgggttccgtcgacggtcggacgaactacgagtcggacggtccggtcgggtccccgacgacggtccgtaccggggaacggggaacgggtccgtagggtaggtggtaacttcttacgtattttagttagtacggttggtacgtaaaccccacgtactaccgtaacacgtaaacgtaccgtcggtacgaaccgggtctactaccgaacctatccaanaacgtaaacaactaacttacgaaacgaaactactaattagttactacttaaacaaataacgaaagtaaccgtaagacgacggacgaaacggcctaacggactaagtcttaancgttaggtggtacgggttnttaacgttcgtaccggcccgggttccgggcccggttaccgtcgaccctcccgtccctaccccgacctaaccgaacccgtaaccgg

SEQ ID NO: 418497 - DNA, 800 bp, Homo sapiens
  misc_feature: GZ8MTXP01BZCE3.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtggaggaggcttgatccagccgtgggggtccctgagactctcctgtgcagtctcgtggttcgtcgaggtggcgactacagtggagcgtcgggtcccgccgacggccgtaccggaaggggaacgggccgtgggacggtgggtactccttactaacttttatttagtaggttcgggtacggtaaccccacgtactaacctaaccaacgtaaacgaacccgtccgggtaagggaacggggtacccgtaactttacccaacctacttcctaacgaagaaaacggtaactaacgttaccgaaaggaaaccctacgtaatttaggtacttacttaaacaaaagttaacggaaacttaaacccgttagggaaacggaccggacccgggaaacggtaacccaaaccggggtaccctagtttaacggttaactttaccggtgggttaacggggtcggggttacttaacggtttttcccgttaacccgggacccccggggttacggggggggttcccccgggaaaccccggtttcgggtacccccaaccccggttaccccctaccccccgttacccctaaccccgaacccgtaacccccgggg

SEQ ID NO: 418498 - DNA, 677 bp, Homo sapiens
  misc_feature: GZ8MTXP01ARCTV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgcaggctcgagggaggctggagtggatctcactttatttagtagtggtcggtaccccactataccacacaagacctccgtaggaacgggccgattccaccatctacaagaaacgactaacttacccgaaggtaaaccactaatttacgtaacttaccttaacaaaagttacgaaacgttaaacccgtagggaaacgaaccggacccggaaacgggaacccgtaaccggggaccctaagttacggttaactttaccggtggtcgggtacggggttactacgttttaccgtccgggtaacccccgggttgggggaccccgggttaaccctcggggccctaacccggtcccctccccgaccctcccgaaccgtaacccggg

SEQ ID NO: 418499 - DNA, 623 bp, Homo sapiens
  misc_feature: GZ8MTXP01DEYYG.21.78.H01.1.454.CMB.2.raw
  modified_base (419)..(419): a, c, t, g, unknown or other
  modified_base (422)..(422): a, c, t, g, unknown or other
  modified_base (427)..(427): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcaggttggtggagacgtgggaggaggcttgatccgacggccgtgggggtccctgagactctcctgtgctagtctcgtggttcgcagtggcgactacatgagcgtcgggtcccgacacggccgtcggaggggaacgggccgtggaggtgtactcttactactttagtttataggtggtacgtaccccactatactacacaacgactcgagaacggcgatcacancanagaanactatcaagactactatgatctacaaatacgaatacgtagaagcgaccggtagacacggactagtgtattcgtgtcgggtggttacttacgttacgttaccggccccggttacgggggcccggttaaccccggtcgggtaccctaaccccggttcccctacccccgttaaccccgtcccgaacccggtaacccggg

SEQ ID NO: 418500 - DNA, 648 bp, Homo sapiens
  misc_feature: GZ8MTXP01AXO27.21.78.H01.1.454.CMB.2.raw
  modified_base (180)..(180): a, c, t, g, unknown or other
  modified_base (299)..(299): a, c, t, g, unknown or other
  modified_base (317)..(317): a, c, t, g, unknown or other
  modified_base (437)..(437): a, c, t, g, unknown or other
  modified_base (480)..(480): a, c, t, g, unknown or other
  modified_base (538)..(538): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagtttggctgagcgttgggttttccttgttgctattacaaaggtntccagtgtgaggtgcaggttggtggagacgtggaggaggcttgactccgaggccggtcgggggtccctgacgtacctctccgtgtgctacgtctcgtgggttccgtgagtggcgactantgacgtccgtcgggtccncgacggcgtaccggaggggaacgggctagggagtggtatctacgtatttattgtaggtggtagtaccccatatactacacgaactacgtcggtgaaacgggcctactaccactataccanaaagaacactaacgtcaaagtaccattatatactaccttaaanaaagtagaaacgtacgaggacgacggtacgacgtaacgcgtactagtacgttatcggngttaaggtcgttactacgttccggtaccgggtaccccgggttcgggggcccggttaccgtccgtaccccgtcccgtccccacccccgaccgtaacccgaaccggtaaccg

SEQ ID NO: 418501 - DNA, 773 bp, Homo sapiens
  misc_feature: GZ8MTXP01AKRIW.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgagcgtcgggtcccgccgaggcctccggaaggggaacggccgtgggagtggatctactactttatttagtaggtggtacgtacccccactatactaacacgtaaagaccctcggtagggaaacggggtcccgtatttacccgaacctacttaccgtacgaaagtaaacgaaccttaaagttccccgaaaggtaaacccattaagtttagttaccttaccttaaactaaaacgttacggtaaaacttaaaccccgtaggaaacgggaaccggaacccggaaagggaaccccaacgggtacccctaaagtttcggtaaacgtttaaccgtgggggttcggttaacgggggttacctttaacggttttaccgttacccgggaacccccggggttccggggggttacccgggttaacccccgttggggtacccctaaccccgtttccccacccccgttaaccccgtccccgaaccggtaacccccgggg

SEQ ID NO: 418502 - DNA, 649 bp, Homo sapiens
  misc_feature: GZ8MTXP01AOV6Y.21.78.H01.1.454.CMB.2.raw
  modified_base (398)..(398): a, c, t, g, unknown or other
  modified_base (404)..(404): a, c, t, g, unknown or other
  modified_base (492)..(492): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctctgtgcagtctcgtgggttcgtcaggtggcgactacatgagcgtcgggtccgcgaggctccgaggggaggccgtggagtggatctctacttatttatagtggtcgtaccccacatactacacaacgacctcgtagaacgggcatcacatcanaagaanactaatccgaagaacactattagatacttaacaaatagaaactaacgtgaacgacgaccgaagacacggactaagtgttaacttacgnggttcgggtcggggttacttaacgttttccggtaaccccggggtccccgggttacgggggggttacccccggggttaaaccccgttcgggtaccccgtcccccggttccccctaccccccgttacccccttaaccccggaaaccccggaacccgggg

SEQ ID NO: 418503 - DNA, 719 bp, Homo sapiens
  misc_feature: GZ8MTXP01AO6TX.21.78.H01.1.454.CMB.2.raw
  modified_base (256)..(256): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccgagccgtgggggtccctgagactctcctgtgcngtctcgtgggttcgtcaggtggcgactacatgagcgtcgggtccgccgaggcctcccggaagggggaacggggcctggggagtgggtatcctctaactttattttaagtaggttggttacggtaacccccacattaacctaccaaccaacggtaccgttcccgtagggaaacgggtcccgtaattcccgaaccatcctacaagaacgaacaaacttaccgaaacggaactactatttacgtattaccttaacaaatagaaacttaaccgtaggacgaacggaccggaaggaaccgacgggacctaagttcgttaattacgtggtcggttcggggttacttaacgttttaccgttccggtaccccgggttcggggggttaccccgggggttaaccccgttcgggtccccgtaaccccggttccccgtacccccgttaccccgtcccgaacccgtaaccccgggg

SEQ ID NO: 418504 - DNA, 655 bp, Homo sapiens
  misc_feature: GZ8MTXP01CNINE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggtcttgatccgaggccggtcggggggtccctgagtactctcctgtgctagtctcgtgggttcgtcgaggtcggcgactacagtgacgtcgtcgggtcccgcgacggccgtaccggaggggacgggccgtggaggtggactctactactttatttagtagtcggtacgtaccccatactactacacaacgtactcgagacgggctatcacatctagagaacgtactaactaccgaagaactactattacgtacttacgttaaacaaagtacgaaactaacgtaaggacgaaccggaccgaacgaaccgaccggactagtacgtattcgtggtggtaggcttacgttcgtacccgggtcccggttcgggggttccccggttaaccgtcggtaccctaacccgtccctacccccgacccgtaaccgaaccggtaacccgg

SEQ ID NO: 418505 - DNA, 689 bp, Homo sapiens
  misc_feature: GZ8MTXP01CYQ5R.21.78.H01.1.454.CMB.2.raw
  modified_base (514)..(514): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtcctgagtactctctgtgctagtctcgttgggttcgtcgaggtcggacgactacagtggagcgtcgggtcccgcgacggcctaccggaggggaacggccgtggaggtggaattcttactaacttttagtttagttaggttggtacggtaacccccaataacgtacctaacaacgaacgtacctccggtaggaaacggggtcctaatccacctactcctacgaagaaacgaactaacgttaccgaaggtaacaactagttatacttactaacaaatnaaacgttacgtaggaagacggaccgacggaaccgaccggtacagtaacgttagttacgtgggttggtcggggttacttaccgtttaccgtcccggccccgggttacgggggccccgggttaccgtccgggacctcccgtcccctaccccgaccctaacccgaaccgtaacccggg

SEQ ID NO: 418506 - DNA, 700 bp, Homo sapiens
  misc_feature: GZ8MTXP01B83LK.21.78.H01.1.454.CMB.2.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtcttcgtgggttcgtcaggtggcgactacatggacgcgtcgggtaccgccgaggcctaccggaggggaacggccgtgggagtggatcttactacttttatttagtaggtcggtacggttacccccatactactaacacaaagacctccgggtagaaacgggggtcctagttaccacctacgtcctacgaagaacggaactaacgttccaaggtaaacctaactattagtactacttaacaaatagtaaactaaccgtagacgacgacgaaggaccgacggacctagtattacttacgtggttaacgggtggggttacttacgtttaccggttacggtacccccgggttcggggggttaccccgggttaaccccggttcgggtccctaaccccggttcccctacccccggttaccccttccccgaacccggtaaccccgggg

SEQ ID NO: 418507 - DNA, 718 bp, Homo sapiens
  misc_feature: GZ8MTXP01BZ9BI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagactggaggaggcttgatccagccgtgggggtccctgagactctcctgtgcagtctcgtgggttcgtcagtggcgactacatgagcgtcgggtacccgccgaggcctaccggaggggaacggggccctgggagtggtactcttctaactttatttagtaggtgggtcggtaaccccatatacctacacaacgacctcggtaggaacgggcctataccgaccagttccacaagaacgaacaacttaccgaaaggaaccatactttacgtattccttaataaactagtaaacgtaacgttaggaacggacggtacccggaaggacccgaaccggtacctaagtttacggttaacgtttaaccgtggggttgggttcgggggttacttaacggttttaccgttaccgggtaacccccggggttcggggggttaccccgggttaaccccggttcggtaccccgtaaccccggttcccctacccccgttacccctcccggttaacccggtaaccccgggg

SEQ ID NO: 418508 - DNA, 690 bp, Homo sapiens
  misc_feature: GZ8MTXP01CX7D3.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtggggggtccctgagactctcctgtgcagtctcgtgggttcgtcagtggcgactacatgagcgtgggtcccgcaggctccgagggaaggccgtggagtggatctctactttattagtagtggtcggtaacccactatactaacacaaacgaccgtccggtaggaaacggggcccgtaattccaacctatcctaccaaaggaaacaacctaattacccgaaaggaaactacgtaatttcgtaaacttacgttaacaaaagtacgtaaactaaaccgtggaaacgacggaccgaagggaccacgggacctaagttgttaaacttcgtggtggttcggggacttaacgtttccgttaccggccccgggttacggggggccccgggttaaaccccggttcgggtacccctaacccgggttcccctacccccgttaccccgttcccgaaccccggtaaccccgggg

SEQ ID NO: 418509 - DNA, 687 bp, Homo sapiens
  misc_feature: GZ8MTXP01A7VSB.21.78.H01.1.454.CMB.2.raw
tcagtcgtcgctcgcacgaccggtgctcgatttagtgtgagtagtttgggtttgggggggagaggagcccagcactggggttccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgacgactctcctgtgcagtctcgtggggttcgtcaggtcggacgactacagtgagtcgtcggggtccgccgaggcctccggagggggaacgggccgtgggaggtggacttcgtacttactttaagtttagtaggtggtacggtaacctaacatactacacacgtaaccgtcggtggaacgggtccgtacttcacctatctacagaaacgactaactcgaaggaactactattagtaactacttacaaatacgaaacttaaccggtgaaaggacgaccggaaggaccgacggacctagtagttaacttacgtgggtggtcggggtacttacgtttccggttccggaaccccggggttcgggggaccccggggttacccgttcgggtccccgtaacccgttccccgaccccccgtaccgttaccccgaaccggaacccgggtccccg

SEQ ID NO: 418510 - DNA, 643 bp, Homo sapiens
  misc_feature: GZ8MTXP01EZMFY.21.78.H01.1.454.CMB.2.raw
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttgggtggagacgtggaggaggcttgatccagccgtgggggtccctgagactctcctgtgcagtctcgtgggttcgtcaggtggcgactacatgagcgtcgggtcccgccgaggcctccggagggacgggccgtggagtggatctctactttatttataggtggtacgtaccccacatactacacaagactccgtagaacgggccatcaccatctacaagaacaactaactccaggaaaccactattgaacttacttaacaaatgaaactaacctggaacgacgaccggaacggaccaccgggacctagttgtaattacgtggtggtggggttctagttttaccgttcccggaaccccgttcggggggaccccggggaacccttcgggtaccctaaccccgtcccctaccccccaccccgtaaccccgaaccccgtaacccgggg

SEQ ID NO: 418511 - DNA, 729 bp, Homo sapiens
  misc_feature: GZ8MTXP01EF7ZN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgagccgtgggggtccctgagactctcctgtgcagtctcgtgggttcgcgagtggcgactacatgagcgtcgggtcccgccgaggccgtaccggaaggggaacgggccgtgggaggtggtacttcttacttaactttatttagtaggtcggtacggtaaccccatatacctacacaacgactccggtagaacgggccattaccactatctacgaagaacgaactaacttaccgaaaggtaaacacttaatttacgtaacttaccttaactaaaattacgtaaacttaaacccgtaggaacgacggaccggaacggaaccgaccggaccttagttacgttaacgtttaccgtgggttaacgggttcgggggttactttaacggttttaccggtacccgggtaaccccgggttcggggggttaccccgggttaaccccgttcgggtacccgtaaccccgttccccaccccccgttacccgttaaccccgaacccggtaaccccggg

SEQ ID NO: 418512 - DNA, 623 bp, Homo sapiens
  misc_feature: GZ8MTXP01EJNBY.21.78.H01.1.454.CMB.2.raw
  modified_base (412)..(412): a, c, t, g, unknown or other
  modified_base (418)..(418): a, c, t, g, unknown or other
  modified_base (432)..(432): a, c, t, g, unknown or other
  modified_base (437)..(437): a, c, t, g, unknown or other
  modified_base (450)..(450): a, c, t, g, unknown or other
  modified_base (484)..(484): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtggggggtccctgagactctcctgtgcagtctcgtgggttcgtcagttggcgactacatgagcgtcgggtccgccgaggcctccgaggggaacgggccgtgggagtggatcctactactttatttataggtggtcgtaccccatatactacacaacgactcgtagacgggccattcacatctnaagaanacatccgagaaacnctatntatctacaaatanactagagagcgacgacgcgacactgtacttacgnggtggtcggggttcttagtttaccgtttaccggaccccggggttccgggggttacccgggggttaccccgttacggtcccggtacccttccccgtacccccggtaccccacccgtaaaccccgaacggggtaacccccg

SEQ ID NO: 418513 - DNA, 811 bp, Homo sapiens
  misc_feature: GZ8MTXP01CUC6Y.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgctagttggtggagacgtggaggaggcttgatccagccgtgggggtccctgagactctcctgtgcagtctcgtgggttcgtcgaggtggcgactacagtggagtccgtcgggtcccgccgaggcctaccgggaaggggaacgggccgtaggggaggtggacttaccttactaacttttaagtttagtaggttgggtacggtaacccccaactaacgttaacctaacctaaccgtaaacgggtacccgttccgggtagggaaacccgggggtccctaacttaccaaccctacttccgtaccgaaagaaaacgtaaacctaaacgttacccgaaaggtaaactaccttaagtttacgtaaacttaccgttaaactaaaagttacggtaaaaccttaacccggtaggaagaaccggacccggaaaggtaacccgaaccgggtacctaaagttacggttaattaccggttgggttaacgggtcggggttacctttaacgttttacccggtacccgggtaccccggggttcggggggaccccgggttaacccgttccgggtaccctaaccccggttcccctaccccccgttaccccgtaaccccgaacccggtaaccccggg

SEQ ID NO: 418514 - DNA, 708 bp, Homo sapiens
  misc_feature: GZ8MTXP01A9YE0.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacagtgagcgtgggtcccgccgggctccgaggggacggcctggagtggactcgtctactttatttagtagtggtcggtaccacatactacacagaacctccgtggaacggccgtattcacatctacagaagactaactccaaaggaactaactatttacgaattcttaaactaaagtacgtaaacgttaaaccgtggaacgacggaccggaaacgacccgaccggacctaagttacgtaaccgtttacgtcggttgggttaacgggggtactttaacggttttaccgttcccgggtaacccccgggtccggggggggttaacccccggggttaacccgttccgggggtaacccctaccccggttccccctacccccccggaccccttacccccggaaaccccggaaccgggggtaaccccccc

SEQ ID NO: 418515 - DNA, 765 bp, Homo sapiens
  misc_feature: GZ8MTXP01B3NIN.21.78.H01.1.454.CMB.2.raw
  modified_base (258)..(258): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtcagtgtgaggtgcagttggtggagacgtggaggaggcttgatccgaggccgtgggggtccctgagactctctgtgcngtctcgtggtcgtcgaggtggacgactacagtggagtcgtcgggtccgccgaggcctaccgggaaggggaacgggccgtagggacgttgggacttcttactaacttttagtttagtaggtcgggtacgtaaccccactactaactacacaacgtaccgtccggtagggaacgggtcccgtacttaccaccgtatacctacgaagaaaacgaactaaacgttaccgaaaggtaaacctacgtaatttacgtaacttactttaaacaaaattacgaaaacgttaaaccgtgggaaacgacggacccggaaggaacccgacggtacctaagttacgttaacgttaccggttgggttcggggtacgggggttactttaacggtttaccggttcccgggaaccccggggttcgggggggacccccggggttaacccgtttcgggtaccccgtaaccccgggttcccctaccccccggttaccccgttaaccccggaacccggtaaccccggg

SEQ ID NO: 418516 - DNA, 750 bp, Homo sapiens
  misc_feature: GZ8MTXP01E3RNO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagcgtgggggtcctgagactctcctgtgcagtctcgtgggttcgtcgagtggcgactacagtgacgcgtcgggtcccgccgaggcctaccggaggggaacgggccgtagggagtggatctactaactttatttagtaggtggtacgtaaccccactatactaacacaacgtacctccggtaggaaacgggcccgtattaccaacctatacctacaaaggaaacgtaacctaaacgttaccccgaaagggtaaacctacttaaagtttacgttaacttaccgtttaaacaaaagttacggtaaaaacctttaacccgagggaaacggaccggaaccccgggaaaggaacccgtaaccgggaccctaagttacggtttaacttacggtgggtaacgggtcgggttacttacgttttaccgtaccgggtacccccgggttcggggggaccccggggttaaccccttgggacccctaaccccggttcccctaccccccgaccccgtaacccgaacccggtaacccggg

SEQ ID NO: 418517 - DNA, 807 bp, Homo sapiens
  misc_feature: GZ8MTXP01DPYGQ.21.78.H01.1.454.CMB.2.raw
  modified_base (267)..(267): a, c, t, g, unknown or other
  modified_base (282)..(282): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggtagttttggctgagtcgttgggttttccttgttgcttatttcaaaaggtgtccagtgtgaggtgcgtaggttggtggagacgtgggaggaggtcttgatccgaggccgtcgggggtccctgagactctctgtgcngtctcgtggttcgtngtggcactacatgagcgtcggtccgcgaggccgtaccggagggacggccgtaggtaaggtggtacttccgttacgttaacttttagtttaagtaggttcgggtacggtaaccccaactaacgtaactaaccaacgtaaacgtaccgttccgggtagggtaaaccgggtcccgtaacttacccaacctacttcctaaacgaaaggtaaacgtaactaaacgttacccgaaaagggtaaaacctacgttaagtttacgtaattaccccttaagtaaaaacttcggtaaaacttaaacccggtaggaaacggaccggacccggaaacggtacccgaaccgggaccttagttagtttaacgttaacgttggggttaacgggtggggttaccttaacggttttaaccggtcccgggtacccccggggttacggggggttaaccccgggttaaccccgttcgggtacccctaaccccgggttacccctaccccccgttaaccccgtccccgaaaccgggttaacccccggg

SEQ ID NO: 418518 - DNA, 664 bp, Homo sapiens
  misc_feature: GZ8MTXP01AORZQ.21.78.H01.1.454.CMB.2.raw
  modified_base (293)..(293): a, c, t, g, unknown or other
  modified_base (433)..(433): a, c, t, g, unknown or other
  modified_base (482)..(482): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcgagttggtggagacgtggaggaggtcttgatccgaggccgtgggggtccctgagactctctgtgcagtctcgtgggttcgtcgaggtggcgactacngtgagcgtcgggtccgcgaggcctaccggagggacggccgtggagtcggatctctacgtttatttagtaggtcggtacgtacccactatactacacaacgtactccgtaggaacgggccacttccacatacacaaagaanaactactccgaagaacactattcgtatctaacaaatcgaaacttaacgngaagaccgtacgaaggcgtacggacctagtcgttaacttacgtggtgggtcgggttaccttacgtttaccggtcccggtaaccccgggttcggggggttaccccggttaacccttcggggtacccctaacccggttcccccgtaccccccgttacccgtcccgaaaccccgggtaacccggg

SEQ ID NO: 418519 - DNA, 725 bp, Homo sapiens
  misc_feature: GZ8MTXP01ATNU3.21.78.H01.1.454.CMB.2.raw
  modified_base (686)..(686): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgacgactctccgtgtgcagtctcgtgggttcgtcgaggtggcgactacagtgacgcgtcgggtcccgccgaggcctccggaggggacggcgtggagtggatctctacttattagtaggtggtacggtaccccatactaactacgacaacggtaccgtccgtaggaaccgggtcccgtagttaccaccgtatacctacgaaagtaaacgtacgtaaacgttacccgaagggaaacctattaacgtttagttaaccttacttaaacggaaaattaacggtaaactttaaaccgtaggaagaccggacgaacgggaccaccgggactagtacggttaacttcggtagggttggggtacggttctaagtttttacccgcggggtacccccgggttacgggggggcccccggttaaacttccgggttaccccaaccccgggttaccccncccccggttaacccctcccggaaaccggttaaccccggg

SEQ ID NO: 418520 - DNA, 636 bp, Homo sapiens
  misc_feature: GZ8MTXP01D1D0M.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgcttatttacaaaaggtgtccagtgtgaggtgctagttggtggagacgtggaggaggcttgactccgagtccgtgggggtccctgagctctcctgtgcagtctcgtggttcgcaggtggcgactacatgagcgtgggtcccgccgaggcctccgaggggaacggccgtggagtggatcctactacgtttatttataggtggtcgtaacccccactataacctacacaaagaccttcggagaacgggcctattccactatctacaagaaacacaattaccgaaggaaacactattgtaacttactacaaattagaactaaccgtggaagacgcgagacgacgactatgtacttagtgtggtgggttacttacgttttacgtccggaccccgggttcgggggcccgggttaacccgttcggtccccgtcccgttcccgtacccccacccgtaacccgaacccggtaacccggg

SEQ ID NO: 418521 - DNA, 690 bp, Homo sapiens
  misc_feature: GZ8MTXP01EMV3U.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtggaggaggcttgactccgagccgtgggggtcctgacgactctctgtgcagtctcgtggttcgcaggtggcgactacagtggacgcgtcgggtcccgcgaggcctccggaggggaacgggccgtgggagtggactctctaacgtttatttagtaggttcggtacgtaaccccagtaactactaacacgtaaacgacctccggtaggaaacgggcctattaccaacctatctacgaagaaacgactaaacttacccaaggaaacctattaagttcgtaattaccttaagaaatacgaaacttaaccgtggaacgacggaccgaggacgacggacctagttgtattacgtgggtaacggttgggccttaaacgtttcgtccggggtaaccccggttcggggggaccccgggttaacccgttcgggtaccccgtaacccggtcccctacccccgacccgttaacccgaacccggtaacccggg

SEQ ID NO: 418522 - DNA, 634 bp, Homo sapiens
  misc_feature: GZ8MTXP01AE1XO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtcgggtcccgccgaggcctccggaaggggaacgggcctagggagtggatcgtactactttatttagtaggtggtacggtaaccccacataactacacaacgacctccgtaggaaacgggccgtatccaacatctacaagaagacaacgttccgaaggaaccactattagtaatacttaacaaattacgaaactaaccgtggaagacgaccgagacacggaccatgtaacttgtgtggtcgggttctacgtttacgtccggtaccccggttcgggggcccgggttacccgtcggtccctaaccccggtcctacccccgaccctcccgaacccgtaacccggg

SEQ ID NO: 418523 - DNA, 675 bp, Homo sapiens
  misc_feature: GZ8MTXP01EDRA5.21.78.H01.1.454.CMB.2.raw
  modified_base (180)..(180): a, c, t, g, unknown or other
  modified_base (632)..(632): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtntccagtgtgaggtgctagttggtggagacgtggaggagcttgatccagtccgtgggggtccctgagactctctgtgcagtctcgtggttcgcagtggcgactacgagtgacgtcggtcggtcccgacgacggccgtacggaacgggaacggtccggtaggaggtcggtacttccgttacttaacgtttagtttagtaggtcggtacgtacccactaactacgtaccacgaaacgtaccgtcggtaggaacggtaccgtactaccaactactacacgtaagaactaactacgtaccgaaagaaacctatattagtacttaactaataaatacgaaacttacgagaacgagaccgagacgccgaagtgttgtaactcggtggtaacgggtacggttactttacgtttacggaccccggacccggggttaggggaccccgttactcgggaacccnccggttccccacccgttacccgtaaccgaaccggtaaccccgg

SEQ ID NO: 418524 - DNA, 774 bp, Homo sapiens
  misc_feature: GZ8MTXP01A7JQO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgtgggttctcagtggcgactacatggagcgtgggtcccgccgaggcctccggaaggggacgggcctgggaagtggactcgttactaactttagtttagtaggttggtacggttaacccccacattactaacacaaacgtacctccgtaggaacgggccctattccaactagtacctacgaaagaaacggtaactaacgttacccgaaaggaaacccagttaatttacggtaattaccttaaacgaaaattcggtaaaaactttaaccccgtagggaaaacggaccggaccgggaaacggaccgaacccggggtacctaagttggttaaaactttccggtggggttaagggttgggggaaccctttaagttttaaacccgggttcccgggtaaacccccggggttcggggggttaccccccgggggttaaacccgttgggtacccccgtccccgggttaccccctaccccccgttaccccgttaaccccgaaaccccgggttaaccccgggg

SEQ ID NO: 418525 - DNA, 708 bp, Homo sapiens
  misc_feature: GZ8MTXP01BLII7.21.78.H01.1.454.CMB.2.raw
  modified_base (364)..(364): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccgaaggggaagggcctggagtggatctctactttattatagtggtgtaccccanatactacacaagactccggtagaaacgggccgattcaccatctacaagaacgaactaacttacccgaaggaaaccacgtaatttcgtaaacttctttaacaaaagttcggaaaacttaacccgtggaacgacgacccggaaggaacccacgggacccagttacggttaactttaacgtggttgggtacgggggttacttaaacgttttaccgttaccgggtaacccccgggttcggggggaccccggggttaaaacccccttgggggttacccccaaccccgggtttcccccgtacccccccttaaccccggttaacccccgaaacccggtaaacccccggggg

SEQ ID NO: 418526 - DNA, 742 bp, Homo sapiens
  misc_feature: GZ8MTXP01ARGY0.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgagtgcagttggtggagactgggagggagtcgttagactccgagtccgggtcgggggtccctaggacgtactctcgtgtcgctagtctcgtggtcgtacgaggtcggacgactacagtgacgtcggtcggtccgaccgtaggccgtaccggaaggggaacgggcgtgggtagtcggtactcctacgttaacttttaagttaaggtaggtcgggttacggtaaccccctactaactaacctaaccgacgtaaacgggtacccgtccgggtagggaacccggggtacctacttacccactacttaccgacaaaggaaacgaacctaacgttaccgaaacgtaaaccattagttacgtattaccttaagaaaatacgtaaacgtaaccgtaggaagaccggtaaccggagaccgacggactagtacgttacgttacgtgggtggtcggttacttaacgtttcggaccggtaccccggggttacgggggttccccggaccgttccggtacccgaaccccgttccccgaccccgttacccctcccgaacccgggtaacccgg

SEQ ID NO: 418527 - DNA, 640 bp, Homo sapiens
  misc_feature: GZ8MTXP01A8RGD.21.78.H01.1.454.CMB.2.raw
  modified_base (518)..(518): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgcagtggcgatacatgagctgggtccgcgtaggcctccgaggggacgggccgtggagtggatctacgtacttatttagtagtggtggtaccccacatactacacaacgacctccggtaggaacggggaccctacttacacctatctaccaagaaacggacaaattcccaaggaaaccatattgtaatcttacaaatgtaaactaaacgtagaagacgccggaagacgaacggcctaaatggtaattacgngttggcggggcttaagtttccgtacggtacccccgggttaggggggttccccgggaacccgttcggtacccgtaacccggtccctacccccgacccgttaacccgaacccggtaacccgggg

SEQ ID NO: 418528 - DNA, 697 bp, Homo sapiens
  misc_feature: GZ8MTXP01C66I1.21.78.H01.1.454.CMB.2.raw
tcagtcgtcgctcgcacgaccggtgctcgatttagtgtgagtagtttgggtttgggggggagaggagcccagcactgggatttcgaggtgtttccattcggtgatcagcactgaacacagaggactcaccatggagttttggctgagcttgggttttccttgttgcttatttcaaaaggtgtccagtgtgaggtgcagttggtggagacgtggaggaggcttgatccagccgtgggggtcctgagactctcctgtgcagtctcgtggttcgtcaggtgcgactacatgagcgtcgggtccgcgaggccgtaccggaggggaacgggccgtgggaggtggacttcgttactaacttttatttaagtaggtggtacgtaaccccactatactacacaacgactcgtagaacggccgtatccacatcacgaagaacgaactaattaccgaaaggaaactaactaatttacgtaacttacttaactaaaatacgtaaacttaaaccgtaggaacgaaccggaccggaaaggaaccgacggtacctaagttacgttaacttacggttggttaacgggtcgggttactttaacgtttccggtaccgggtccccgggttaccggggggcccgggttaacccgttcgggtaccctaacccggttcccctacccccgacccctaaccccgaaccggtaaccccggg

SEQ ID NO: 418529 - DNA, 772 bp, Homo sapiens
  misc_feature: GZ8MTXP01AH9AZ.21.78.H01.1.454.CMB.2.raw
  modified_base (287)..(287): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtccctgagactctcctgtgcagtctcgtgggttcgtcgaggtggcgactacntggagcgtcgggtccgccgaggcctcccggagggaacggggccgtggaggtaggatctactaacttttatttagtaggttgggtcggtaaccccaacgtataacctaacaaccgaacgtaccgttcccggtaggaaacggggtcccgtactttaccaccactctaaccgaagaaacgaactaattacccgaaggtaaaccactatttagtaacttacttaactaaagtacgaaacttaaaccgtaggacggaacgaccccgggaaaggaccgaacgggtaccctaaagttccgttaagtttaaccggtgggttaaggggtcgggggttacctttaaacttttaaccgggttaccggggtaaccccccgggttacggggggggttcccccggggttaaacccgtttccgggggtaccccctaacccggttcccccccgttaccccccgaacccccgttaacccgaacccccggggtaaaccccggg

SEQ ID NO: 418530 - DNA, 733 bp, Homo sapiens
  misc_feature: GZ8MTXP01EMEYO.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctctgtgcagtctcgtgggttcgtcgaggtggcgactacatgagctgggtcccgcaggctccgagggaacggcctggagtggatctactactttatttagtaggtggtcggtaaccccaactagtaacctaacaacgaaacggtaccttcccggtaggaaaccggggacccgtatttacccaaccactttacctaccgaaagaaacgtaaccaaactttacccgaaagggtaaaccaactaagtttagtaacttcgttaactaaaagttacggaaaacttaaacccgtaggaacggaacggacccgggaacggaaccgaccgggtacctaagttaggttaatttaccgtggttaagggtcgggggttactttaacgttttaccggtaccggtacccccgggttaggggggccccgggttaacccgtcggggttacccaaccccggtccctacccccgacccttaaccccgaaccgggtaaaccccggg

SEQ ID NO: 418531 - DNA, 585 bp, Homo sapiens
  misc_feature: GZ8MTXP01EATYE.21.78.H01.1.454.CMB.2.raw
  modified_base (561)..(561): a, c, t, g, unknown or other
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctggggtccgccaggctccgaggggaagggcctggagtggatctcacttatttatagtggtgtaccccacatactacacaagactccggtgaaagggcccgattccgacatctcagaagacaattccagggtaaacacattcgattccttacaaattgaaaggttaacctgaacgacgacccgaggactacgggaccatggttattactggtgtggggcttagtttaaactcggaccccgttgggggcccgggaacctgggtccaaccgtccnccccgaccctcccgcgaacccggg

SEQ ID NO: 418532 - DNA, 913 bp, Homo sapiens
  misc_feature: GZ8MTXP01ART63.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgccatttacaaaaggtgtccagtgtgaggtgcaggttggtggagactggaggaggcttgactccgaggccggtgggggtcccctgacgtacctctctggtcgctagtctcgtcggttcgtcgaggtcggcgactactagtgagtcgtcgggtcccgccggacggtcctaccggaggggaacgggtccgtagggtaggttcggacttcctacgttaacgttttatttaaggttacggtcgggttacggtaaaccccctaaactacgttaaccctaaccgaacgtaaacgtaacccgttcccgggttaacgggaaacggggtcccgtaactttaccgaacctactaccgtaccgtaaaggaaacgtaacctaaaaccgttccccgaaagggtaaacctacctttaaaggtttacttaaaccttaccgttttaaacaaaacgttaacgtaaaaaccgttaacccgttagggaaacggaacccgggaacccggtaacggaaacccgtacccggggttaccctaaagttccggtttaaagtttaacccgggttggggttcgggttaacgggggttaaccctttaaacggtttttaaaccccgggttccccggggaaccccccgggggttttccggggggaaacccccgggttaaacccccggttggggttaccccccgttaaccccggttccccccgtaaccccccccggtttaccccccaaccccggttaaaccccgggtaacccccccgggg

SEQ ID NO: 418533 - DNA, 825 bp, Homo sapiens
  misc_feature: GZ8MTXP01EWQUU.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagtttggctgagtcttgggttttccttgttgctattacaaaggtgtccagtgtgaggtgcgtaggttggtggagacgtgggaggaggtcttgactccgaggtccggtcgggggtccctgacgtactctcgtgtgctagtcttcggttgggttcgtcgaggtcggacgactacagtggacgtcggtcgggtcccgacgacggtccgtaccgggaggggtaacgggccgtagggaaggtcggtacttccttaacgttaacttttaagtttaagtaggttcggttaccgtaacccccaataactaacgtaacacgtaaacggaccgttccgggagggtaaaccggggtaccctaacttacccgaacctacgttacctaacgaaagaaaccgtaaactacgttaacccgaaaggtaaacctaattagtttacgtaactaacttaaactaaagttacgaaacttaaccgtgggaaacgaccgggacgaacgaaccgtacgtacgttaagtacgtttacgttacgttgggtaagggttacgggttaacgttaacgtttttaccccggtaccggggtaaccccggggttccggggggttaaccccggttaccccggttaaccggtacccccgttaaccccggtttccccccacccccggttaacccgttaaccccgaaacccgggttaacccccggg

SEQ ID NO: 418534 - DNA, 655 bp, Homo sapiens
  misc_feature: GZ8MTXP01AK44N.21.78.H01.1.454.CMB.2.raw
  modified_base (523)..(523): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctgacgactctcctgtcgcagtctcgtgggttcgtcagtggcgactacatgagcgtcgggtcccgccgaggccgtccgaggggaacgggcctgggagtggatctctactttagtttagtagtgggtacggtaacccccactataacctacaacaacgaccttccggagggaaacgggccgattccgacactctacaagaaacgactaacttccgaaggtaacacgtattagtatcttaacaatagaaactacgtgagacgcgaggacacgacctatgtaattacgngtaacggtggggttactactttcgtccggaaccccgggttcgggggaccccgggttaacccgttcgggtaccccgtaaccccgggttcccctcccccgttaccccgttccccgaaacccgtaacccccgggg

SEQ ID NO: 418535 - DNA, 625 bp, Homo sapiens
  misc_feature: GZ8MTXP01AVWSI.21.78.H01.1.454.CMB.2.raw
  modified_base (404)..(404): a, c, t, g, unknown or other
  modified_base (505)..(505): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgagactctcctgtgcagtctcgtgggttcgtcgaggtggcgactacatgagcgtcgggccgcgaggcctcggagggacggcgtggagtggatctctactttattagtagtggtcgtacccacatacacacaagactcggagacgggcactcgacatctanagaacacaactccgaagaacacagtttttagacttacttaacaaatacgaaactaacctaggaacgacgaccgaggaccgacggcctatagtactttacgnggtggtcgggttacttacgtttacgtcccgggtaccccgggttcgggggccccgggttaacccgtccggtacccgtcccgtcccgtcccccgacccgtaacccgaacccggtaacccggg

SEQ ID NO: 418536 - DNA, 653 bp, Homo sapiens
  misc_feature: GZ8MTXP01BG95L.21.78.H01.1.454.CMB.2.raw
  modified_base (367)..(367): a, c, t, g, unknown or other
  modified_base (384)..(384): a, c, t, g, unknown or other
  modified_base (403)..(403): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgcgagtggcgactacatgagcgtgggtccgccaggcctccgaggggaacgggcctggacgtggatcgtctactttatttagtagtcggtagtaccccanatactacacaagctcgngaaacgggcattcacatcncagaagacaattccaaggaacactattgtatcttacaaattagaaacttaaaccgtggaacgacggaccgaaggaccaacggacctagtgttaattaccgtgggtcggtcgggggacttaacgttttaccggtaccggtaacccccgggtttcggggggggaccccggggttaaccccgttgggtacccccgtaaccccgggttccccctacccccgaccccgttaaccccgaacccggtaaccccgggg

SEQ ID NO: 418537 - DNA, 556 bp, Homo sapiens
  misc_feature: GZ8MTXP01ANE3W.21.78.H01.1.454.CMB.2.raw
  modified_base (359)..(359): a, c, t, g, unknown or other
  modified_base (394)..(394): a, c, t, g, unknown or other
  modified_base (400)..(400): a, c, t, g, unknown or other
  modified_base (475)..(475): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccaggctccgagggaaggcctggagtggatctctacttatttatagtggtcgtacccanatactacacaagactcgtgaagggccatcacatcncagaanacaatccaaggaacactattagtatcttacaaattgaaataactgaagacgacgagacacggacatgtactacgnggtgtgggctatttacgtcggacccgttgggggcccgggttacctggccaaccgtccaccccgacctccgaaccgaaccgg

SEQ ID NO: 418538 - DNA, 656 bp, Homo sapiens
  misc_feature: GZ8MTXP01CSKFU.21.78.H01.1.454.CMB.2.raw
  modified_base (372)..(372): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtggaggaggcttgatccgagccgtgggggtccctgagactctcctgtgcagtctcgtgggttcgcaggtggacgactacatgagcgtcgggtcccgcaggctccgaggggaacgggcctggagtggatctctactttatttagtagtggtcgtaaccccanatactacacaacgactcgagaacgggccgatccacatcacaagaacgactaactccgaaaggaacacgtattcgtatacttaacaaatcgaaactaaccgtaggaacgacggaccggaacgaccgacggacctagttggtaacttacgtggttcgggtacggggttactttacgtttaccgtaccgggaccccggttcggggggttccccggttaaacccgttcgggacccctaaccccggtccccacccccgttaaccccgtccccgaaccggtaaccccggg

SEQ ID NO: 418539 - DNA, 601 bp, Homo sapiens
  misc_feature: GZ8MTXP01ER8DT.21.78.H01.1.454.CMB.2.raw
  modified_base (457)..(457): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgcaggctccgagggaggcctggagtggatctctactttatttagtaggtggtcgtaccccagtatactacacaagacctcgtagaacgggccagttaccacatctacgaagaagactaattaccgaaggtaaacctacgtattcgtaactaccttaanaaaagtgaaacttaacctggaagacgaccgaaggaccacggactatgtaattacgtgtggtgggctatttcgtcgtaccccggttggggcccggaccctgggtaccctcccgtccctccccaccctcccgaaccgtaacccggg

SEQ ID NO: 418540 - DNA, 700 bp, Homo sapiens
  misc_feature: GZ8MTXP01C3TZJ.21.78.H01.1.454.CMB.2.raw
  modified_base (257)..(257): a, c, t, g, unknown or other
  modified_base (259)..(259): a, c, t, g, unknown or other
  modified_base (274)..(274): a, c, t, g, unknown or other
  modified_base (304)..(304): a, c, t, g, unknown or other
  modified_base (441)..(441): a, c, t, g, unknown or other
  modified_base (452)..(452): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgagttggtggagacgtggaggagcttgatccgagcgtcgggggtcctgagactctctgtncngtctcgtggtcgtcngtggcgactacagtgagtcgtcgggtcccncgacggcctccggaaggggaacgggccgtagggaggtggacttccgttactacttttaagtttacgtaggttcggtacggtaacccactaactacgtaacacgtaacgactccggtaggaacgggtccaatcaactntctacaagaanaacactaccaaggaacaactattacgtattacttaacgtaaatagtaaacgtaaaccgtaggaacgaacgaccggaacggaaccgtacggaacctagttaacgtaactttaccgtggtcggttacgggttactttagttaccgttaccgggtaccccggttacggggggttccccggttaaccccgttgggtacccctaaccccggtcccctacccccgacccgttaacccaacccggtaaccccggg

SEQ ID NO: 418541 - DNA, 672 bp, Homo sapiens
  misc_feature: GZ8MTXP01APJMG.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgaggccgtgggggtccctgacgctctcctgtgcagtctcgtggttcgtcgaggtggcgactacagtgacgcgtcgggtccgccgaggctaccggaggggacggccgtggagtggatctctactttattagtagtggtacgtaccacagtactacacgaagacctcgaggacggccgtactccacactactacgaagaaacgaactaacttccgaaaggaactagtacttgtaacttacgtaacctaaatactaaacgtactaggaaggaccggaaccggaggaaccacgggtacctaagttcgttaacgttacgttggtcgggtacgggttcttaacgtttacgttcccgggaacccgggttcgggggttacccgggttacccgtaacgggtccccaacccgggttccccaccccccgttccgtaaccccgaaccgggtaaccccg

SEQ ID NO: 418542 - DNA, 671 bp, Homo sapiens
  misc_feature: GZ8MTXP01AJNGY.21.78.H01.1.454.CMB.2.raw
  modified_base (254)..(254): a, c, t, g, unknown or other
  modified_base (256)..(256): a, c, t, g, unknown or other
  modified_base (477)..(477): a, c, t, g, unknown or other
  modified_base (485)..(485): a, c, t, g, unknown or other
  modified_base (498)..(498): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagcgtcgggggtcctgagctctcctgtncngtctcgtgggttcgcgagtggacgactacatgagcgttcggggcccgccgaggcccgtaccggaagggggaacggggtcccgtaggggaggtcgggtactcgtacctatttaattttagacggttggttacggtaaccccactatacgtacacaacgaccttcccggaggaaacgggcctaattcacattcgacaagaaacactaatacccgaaggaaacnctaagttntattaccttaaanaagtacgaaactacgagacgacgacgaaggaccgtacgactagtagttacttgtgggttcggcgggttacttacgtttccggtaccggtaccccggggttcgggggttccccggttaccgtccggtccccgtcccgtacccctaccccgttaccctcccgaacccgaacccgg

SEQ ID NO: 418543 - DNA, 690 bp, Homo sapiens
  misc_feature: GZ8MTXP01AIDNM.21.78.H01.1.454.CMB.2.raw
  modified_base (296)..(296): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagtccggtgggggtccctgagacctctcgtgtgctagtcttcgtgggttcgtcgaggtggcgactacngtgacgtcggtcgggcccgaccgaggcccgtaccgggaagggggaacggggtccgtagggaggtggtacttcgtactactttagtttagtaggtgggtcgtaaccccactatactacacgaacgtaccgtcgagggaacgggccgtacttaccgacatcctacgaagaaacgactaaacgttacccgaaaggtaacctaactagtttacgtacttacttaacaaagtacgtaaactaaccgtaggaacgacggaccgaggacgaccgactagtgttaactacgtggtggtcgggacttacgtttcgtacccggaccccgggttcgggggcccggttacccgtcggtcccgaaccccgttcccgtacccccgaccctcccgaaccgaaccccggg

SEQ ID NO: 418544 - DNA, 656 bp, Homo sapiens
  misc_feature: GZ8MTXP01AFHG0.21.78.H01.1.454.CMB.2.raw
  modified_base (194)..(194): a, c, t, g, unknown or other
  modified_base (271)..(271): a, c, t, g, unknown or other
  modified_base (303)..(303): a, c, t, g, unknown or other
  modified_base (356)..(356): a, c, t, g, unknown or other
  modified_base (369)..(369): a, c, t, g, unknown or other
  modified_base (411)..(411): a, c, t, g, unknown or other
  modified_base (525)..(525): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttctgtgctattacaaagtgtcagtgtgaggtgcgagttggnggagactgggaggaggtcttgactccaggccgtgggggtccctgacgtactctctgtcgctagtctcgtgggttccngtagtcggcaactacagtgagcgtcgggtccncgaggtccaccggtagggaacggcgtaggagtggatcgtactactttagttancggtgtacgaccnactacacacgaatacgcgtagaacgggtctatacactatacnaagaactaacaacgttccgaaagtaacctataatttacgtaacttacctaaggaaatttacgaaacttaccgagaacgacggagaaacgcgacggtacctaagtcgtaattcgngggttggcggggttctttaacgttccggttaaccggccccgggggtttacgggggcccccgggttaacgggtcctccgggttaacccccgtcccctacccccgacccgtaacccgttaaccggtaacccgg

SEQ ID NO: 418545 - DNA, 683 bp, Homo sapiens
  misc_feature: GZ8MTXP01DD0II.21.78.H01.1.454.CMB.2.raw
  modified_base (335)..(335): a, c, t, g, unknown or other
  modified_base (474)..(474): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtggaggaggcttgatccgagccgtcgggggtccctgagactctcctgtgcagtctcgtgggttcgtcagtggcgactacatgagcgtcgggtccgcaggctccgagggaggcctggagtggatcgtanacgtttattacgtaggtggtacgtacccactatactacacgaacgtacctccggtagaaacggggtcctattaccactatactacaagaaacgactaaacttcccgaaaggaactactatttagtactacctttaaaanaaatacgtaaacgtaacgtaggaacggaccggaccggaacgaacgaccggtactaagttagttaacgttacggtgggttaacgggtcggttactttaacgtttaccggtaccgggtaccccggggttacgggggcccggttaacccgtcggtaccccgtccccggttaccccacccccgttacccgtaaccccgaacccggtaacccgg

SEQ ID NO: 418546 - DNA, 678 bp, Homo sapiens
  misc_feature: GZ8MTXP01DX7WJ.21.78.H01.1.454.CMB.2.raw
  modified_base (632)..(632): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttctcagtcggcgactacatgagcgtgggtcccgcaggcctcggagggaaggccgtggagtggactctactactttatttacgtaggtggttacggtaccccagtaactactacacgaacgactccggtagaacgggcctagttccacctagtctacgaagaacgaacaattaccaaggtaaacacttatttagtaacttacttaacaaaattcggtaaaacttaacccgtaggaaagaccggaccgaacggtaccgacggacctagtagttacttacgtgggtaaggtcggggttacttaacgtttaccgtccggtaacccccgggttcgggggaccccgggttaacccctcgggttacccncccgttaccccgtcccccacccgtaaccccgaaccgtaaccccggg

SEQ ID NO: 418547 - DNA, 843 bp, Homo sapiens
  misc_feature: GZ8MTXP01C5W6N.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgagttggtggagacgtgggagggagtcttgactccgacggtccgggtcgggggtccctgacgtacctcctccgtgtcgctacgtcgttcggttgggttcgtcgaggtcggcgactacagtgacgtcggtcggtcccgacgacggcctacgggaaggggacgggccgtagggacggtaggtacttccttactaactttagtttaagtaggttcggtacgtaaccccaactatactaacacgaaacgtaccgtcggagggaacgggtaccgtacttaccgaacctatacctaagaaacgtaaacgtaacctaaaccgttaccgaaaacggtaaacctaacgttaagtttacgtaaactttaacccttaaacgtaaaaagtaaccgggttaaaaccttaaacccgggtaagggaaaccggaaccccgggtaaccgggaaaccggaaacccggtaccgggtaacccttaagtttacgggttaaacttcggttaggggttcggggtacggggttaactttttaaaccgtttcgggttaaccccgggacccgggggtttaccggggggacccccgggttaacccgttccgggtaacccctccccggttacccctaccccccgaacccggttaaccccgaacgggtaaccccggg

SEQ ID NO: 418548 - DNA, 834 bp, Homo sapiens
  misc_feature: GZ8MTXP01A9PI8.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcgagttggtggagacgtgggaggaggcttgatccgagccggtcgggggtccctgagactctcctgtcgcagtctcgtgggttctcgagtggcgactacatggagcgtcgggtccgccgaggcctaccggaaggggaacggggcctaggggtagtcgggactttccgtactaacgttttaatttagtagggttacggtacggttaacccccactaacttaacccgtaacaacccgtaaaacgtaccctaaccgggtaacgggtaaaccggggacccgtaactttacccgaaaccctacgtttacccaacggaaaacgaaacggtaaccaaacgtttacccgaaaacgggtaaaccaaccgttaatttacgttaaacttaaccttaaccaaaaagttaacgtaaaacgttaaacccgtagggtaaacggaacgtaccccggggaaggaacccgtaccggggaacccttagtacgtttacttaaccggtggttaacggggtcggggttaacttttacggttacccgttaccggggtaaccccccggttgggggggttaaccccccgggttaacccgtcggtaccccgtaacccccgtttccccgacccccccgttaccctaaccccgttaaccggaacccccggg

SEQ ID NO: 418549 - DNA, 705 bp, Homo sapiens
  misc_feature: GZ8MTXP01B48P4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccgagccgtgggggtccctgagactctcctgtgcagtctcgtgggttcgtcgaggtggcgactacatgacgcgtcgggtcccgccgaggcctccgaaggggaacgggccgtagggaggtggacttcctactactttatttacgtaggtggtacggtaccccactactactacacgaacgacctccggtaggaaacgggtcccgtaacttccgacctattccctacaagaaacgtaacctaacgttacccgaaaggaaacctacgtactttagtaacttacttaacaaaattacggtaaacttaaccgtaggaacgacggaccgaggaccacggacctagttacgttacttacgtggtaagggtcgggttacttacgttttacgtccgggaccccggttcggggggccccggttaacccgttggtaccccgtaacccgttccccgtccccccttaacccgtccccgttaaacccggaacccggg

SEQ ID NO: 418550 - DNA, 752 bp, Homo sapiens
  misc_feature: GZ8MTXP01BT3O9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgtcttatttacaaaaggtgtccagtggtgaggtgcgtaggttggtggagacgtgggaggaggtcttagactccgacggtccggttcgggggtccctggacgtacctctccgtgtcgctacgtccttcgttgggttccgtcgaggtggacgaactacgagtgacgtcggtcgggtcccgcgacggccgtacggaagggaacggccgtaggagtgatctactactttattagtaggtcggtacgtaccctacgtatactaacgacgaaacgtaccgtccggtaggaacgggtccgtacttaccaacgtatccgtaactaaagaaacgtaactaaacgttaccgaaaggtaaacctacttacgtttagtaacttattaaaccaaagtataaacgtaacgtgaacggaacgcggaaacgacgaacggtactagttagttacttacggtggtcggttgggaccttaacggtttaccggtcccgggtaaccccggggttcggggggttacccccgggttaaccgtccggggtccccctaacccggttccccctaccccccgacccgtaacccgttaacccggtaaccccggg

SEQ ID NO: 418551 - DNA, 774 bp, Homo sapiens
  misc_feature: GZ8MTXP01AMK12.21.78.H01.1.454.CMB.2.raw
  modified_base (179)..(179): a, c, t, g, unknown or other
  modified_base (309)..(309): a, c, t, g, unknown or other
  modified_base (312)..(312): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaggtntccagtgtgaggtgcgagttggtggagacgtgggaggaggcttgactccgagccggtgggggtccctgacgtactctctgtcgcagtctcgtgggttcgtcgaggtggcgactacatgagcgtcggtccncgnggcctacggacggggacggccgtagggagtggtacttcgtactactttagtttacgtaggtcggtacgtaaccccatacgtaactaaccacgtaaacgtacccttcggtagggaaacggggtccctacgttaccaaacctacgtaccctaagaaacgaaacggtaaacctaaacgttaccccgaaaaggtaaaccctaacgttaatttacgtaacttacgtttaaaccaaaagttacggaaaacttaacccgtggaaaggaccgaccggaacggaccgtaaccggacctaacgttaggttaaccttaacggtcgggttaagggtacggttacgttaacgttttaccgggtaaccggtccccggggttcgggggaacccgggttaacccgtccgggggtaccctaacccgttccccccgggtaccccaacccccgggttcccgaaacccccgggtaacccggg

SEQ ID NO: 418552 - DNA, 718 bp, Homo sapiens
  misc_feature: GZ8MTXP01AOEVV.21.78.H01.1.454.CMB.2.raw
  modified_base (668)..(668): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctaggttggtggacgacgtgggaggaggtcttgactccgaggccggtcgggggtccctgacgtactctctgtgctgtctgtgggttcgtcgaggtggcgactacagtgacgtcggtcgggccgccgaggccgtacggaggggaacggcgtgggagtggattctacttaactttatttagtacggtggtacgtaccccactataaccacacaacgtacctcggtacggacgggtctacttacacatacacaagaacgactacgtaccaagtaacactattacgtaacttctaactaaaacgtgtaaaaccggttacccgtagggaacggaaccggacccggaacggaaccgacggtacccgtaagtttcgttaaaccgtttgttcggggttcgggtacgggttactttacggtttaaccggtcccggggtaaccgggttcccgggggttacccgggttacccgtcgggttccccncccgggttcccctaccccccgttaccgtaaccccgaacgggtaaccccgg

SEQ ID NO: 418553 - DNA, 692 bp, Homo sapiens
  misc_feature: GZ8MTXP01AY93S.21.78.H01.1.454.CMB.2.raw
  modified_base (356)..(356): a, c, t, g, unknown or other
  modified_base (373)..(373): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgactccgagccgtgggggtcctgagactctctgtgcagtctcgtggttcgtcagtggcgactacagtgagcgtcgggtcccgccaggcctccggaaggggaacgggccgtggagtggactctctacttatttanaggtggtcgtaccccanatactacacaagacctcgtagaacgggccacttcacctatctacgaagaaacgaactaacttaccgaaggaaaccacgtattacgtaacttacttaacaaattagaaacgtaacccgtaggaacgacggacccggaaggaccgacggacctattggttaacttaacgtggtcgggttagggggttaccttaaacggttttaccgtaccgggtaacccccgggttcggggggaccccggggttaccccggttaacgggtaccctaaccccgggttccccaccccccgttaccccttaaccccgaacccggtaaccccggg

SEQ ID NO: 418554 - DNA, 598 bp, Homo sapiens
  misc_feature: GZ8MTXP01AL7M6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagactggaggaggcttgatccagccgtgggggtccctgagactctcctgtgctagtctcgtgggttcgtcgagtggcgactacagtgagcgtgggtcccgccgaggctaccgaggggaacgggcctggagtggatctctactttatttataggtggtcgtaccccacataactacacaagacctccgtagaacgggccgtatcacactctacaagaagactaattccaaggaacactattgtaattcttaacaaatagaaactaacgtgagacgcgagacgacggcagtcgtatacgtgtggtgggctagtttacgtcggaccccgttgggggccccgggttaccctgggcctaacccggtccctcccccgacccttccgaaccgaacccggg

SEQ ID NO: 418555 - DNA, 633 bp, Homo sapiens
  misc_feature: GZ8MTXP01AQZ24.21.78.H01.1.454.CMB.2.raw
  modified_base (286)..(286): a, c, t, g, unknown or other
  modified_base (366)..(366): a, c, t, g, unknown or other
  modified_base (457)..(457): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtccctgagactctcctgtgcagtctcgtgggttctcaggtggcgactacntgagcgtgggtccgcaggctccggagggaacggcctggagtggattctctacgtttattataggtggtacgtaaccccanatactacacaacgacctccgaggaaacgggccgtattcacatctacagaaacgacaacttccaaggtaaacactattagtactaccttaanaaatacgaaactaaccgtggaacgacgaccgaagaccgacggacctgtacgttattacgtgtggtcgggactacgtttaccgtcggtaccccggttcgggggttacccgggaaccccgttggacccctaacccgtccccgtaccccccgacccgtccccgaaccgtaaccccgggg

SEQ ID NO: 418556 - DNA, 665 bp, Homo sapiens
  misc_feature: GZ8MTXP01A88WB.21.78.H01.1.454.CMB.2.raw
  modified_base (262)..(262): a, c, t, g, unknown or other
  modified_base (444)..(444): a, c, t, g, unknown or other
  modified_base (489)..(489): a, c, t, g, unknown or other
  modified_base (552)..(552): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagtcttgggttttccttgttgcttatttacaaaaggtgtccagtgtgaggtgctagttggtggagacgtggaggagcttgactccagccgtcgggggtcctgagactctcctgtgcngtctcgtgggttctcgaggtggacgactacagtgacgtcgtcgggcccgcgaggcctcggagggacggccgtaggagtgactctctactttattagtaggtcggtacgtaaccccagtaactaactaacacgaaacgtaccgtccggtagaaaccgggccctacttaccaacctattccganaagaaacactaacttacgaagtaactactattagtacttactaanaaattagtaaacgtacgtagaacgacggaccgaaggacctacggacctagttacgtacttcgnggtaaggtcggttcttagttaccgtaccggcccggttacgggggcccggaacccgttcggtaccccgtcccgtacccctacccccgacccgtaacccgaaccggtaaccccgg

SEQ ID NO: 418557 - DNA, 702 bp, Homo sapiens
  misc_feature: GZ8MTXP01C2E59.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggcttgatccgagccgtcgggggtccctgacgactctcctgtcgctacgtctcgttgggttcgtcgaggtggcgactacgatgacgtcgtcggtccgcgacggcgtccggaaggggacgggtccgtgggaagtggtagtcctactactttattagtaggtcggtacgtaccccactatactacaacaacgtactccggagaacgggacctacgtcacctatactacgaaagtaacgactaaacttccgaaacggaacaactagtttataacttacttaacaaagttacgaaacttaaccgaggaacgacggaccgaacggaacacggactagttagtacttacgtggtaacggtcgggttacttacgttacggttacccggtacccggggttacggggggttaccccggttaaaccgttcgggtaccccgtaacccggttaccccctaccccggaccccgttcccgaaaccgggtaacccccggg

SEQ ID NO: 418558 - DNA, 614 bp, Homo sapiens
  misc_feature: GZ8MTXP01DI9LT.21.78.H01.1.454.CMB.2.raw
  modified_base (365)..(365): a, c, t, g, unknown or other
  modified_base (408)..(408): a, c, t, g, unknown or other
  modified_base (412)..(412): a, c, t, g, unknown or other
  modified_base (418)..(418): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcgagttggtggagacgtgggaggaggcttgatccgagcgtcgggggtccctgagactctctgtgcagtctgtgggttcgtcagtggcgactacatgagcgtcgggtccgcgaggctccggagggacgggcctggagtggatctactactttattatggtggtcgtaaccccanatacacacaacgtactccggtagaacgggccgtatccaactcnctanagtaanactaactaccaagaacactattagtactactaacaaatacgaaataaccgtagaagaacgacgacggaccgacggacagtgtatacgtggtaaggtcggggttactacgttcgtacgtcccggttacgggggcccggttaaccgtcggtaccaacccggtcccaccccgttaccctaaccgttaacccgaacccgg

SEQ ID NO: 418559 - DNA, 982 bp, Homo sapiens
  misc_feature: GZ8MTXP01A7312.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagtcgttgggtttttccttgttgcttatttacgaaaaggtgtccagtgtgaggtgcgtaggttggtggagacgtgggaggaggtcttgactccgacggtccggtcgggggtcccgagtacctctcctgtgctagttcgttcggttcgggttcgtcgaggttggaccgtaactacagtggacgtcgtcgggtcccgaccggacggccgtacccgggaagggggtaaccggccgtaggggtaggtacgggtacttccgttacccgttaaacgtttttaagttttaacggttagggttcggggttacggttaaacccctaaacctaacttaaacctaaacgaaccgtaacggtaaacccgttacccggttaaggggaaaccgggtcccgtaactttacccaaccgtaacttaccgtaaaccgaaagtaaaacgaaccttaaacgttaccccgaaaaggtaaaccctaacgttagtttttacgtaactttacccggtttaaaaaactaaacgttaaacgttaaaccgttaaaccggggtaacgggaaaccgggaaccccggtaacccgggaaaccggtaaccccggtaaccggttaaaccgttaagtttaacggtttaaccgtttacgggttcggggttaccggggttaacgggtttaacccttttaacccgggttttaccccgggttaccccggggtaaacccccgggggttaccggggggttaacccccggtttacccggttccccgggttaacccccgttaccccccggttaaccccccgttaacccccccgacccccgttaaccccgggtaaccccgggttaaccccgggtcccccg

SEQ ID NO: 418560 - DNA, 697 bp, Homo sapiens
  misc_feature: GZ8MTXP01EON9M.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcaggtggcgactacatgagcgtcgggtcccgccgaggctcccggaggggaagggcctgggaagtgggactcgtactactttagtttataggtggtaggtaccccaacataactacacgaaacgactccggtagaaacggggcctaattccaaccatacctacaaggaaacaactaaacttcccgaaggaaactactatttacgtaatcttaacaaattacgaaaacttaaaccgtggaaacgacggacccgaaggaccgacggtaaccagttcgttattaaccggtggttgggtggggttctaacgtttttacgtaccggtacccccgggttgggggaccccggggttaaccccgttgggggtttacccaaccccgggtttcccacccccccgttaacccgttccccgaaacccggtaaccccgggg

SEQ ID NO: 418561 - DNA, 725 bp, Homo sapiens
  misc_feature: GZ8MTXP01ENUMC.21.78.H01.1.454.CMB.2.raw
  modified_base (319)..(319): a, c, t, g, unknown or other
  modified_base (445)..(445): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagacgtgggaggaggtcttgatccgaggtccggttcggggggtccctgacgtactctccgtgtgctagtctcgtgggttcgtcgagtggcgactacagtgagcgtcggtcccncgacggctacggagggaggccgtaggagtggactctcgtactttaagtttacgtaggtggtcgtaccccactactactacacgtaacgacgtcggtagacgggccgtacttaccgacattacctanaagaaacgaactaaactaccgaaggtaaaaccacttaagttactaattccttaataaattacggtaaacttaaccgtagaacgacggaccgaaagacccgtaacggacctagttacgttaagtttacgtgggttgggtacggggttacttaacggtttttaccgtaccggggtaaccccgggttcggggggaccccgggttaaccccgggttggtaccccgttaaccccggtccccgtaccccccgacccttaaccccggaaaccccggtaaccccgggg

SEQ ID NO: 418562 - DNA, 659 bp, Homo sapiens
  misc_feature: GZ8MTXP01BS6H5.21.78.H01.1.454.CMB.2.raw
  modified_base (309)..(309): a, c, t, g, unknown or other
  modified_base (328)..(328): a, c, t, g, unknown or other
  modified_base (382)..(382): a, c, t, g, unknown or other
  modified_base (395)..(395): a, c, t, g, unknown or other
  modified_base (568)..(568): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcgttgggtttttccttgttgcttatttacaaaaggtgtccagtgtggaggtgctaggttggtggagacgtgggaggaggtcttgactccgagtccggtcgggggtccctgacgtactctcgtgtcgctacgtctcgtgggttctcgtaggtcgcgactanagtgagcgtcggtccgcgnggccgtaccggagggacggccgtaggagtcggtatcctacgtactttagttagnggtgtacgaaccnctagactacacaacgactcggtagacgggtcctactcaacctagtactacaagtaacgaactactaccgaagtaactaacgtagttataactacttaaacaaagtttacgaataaccgtagacgacggacaggtaccgacggtcttagtggtacttgtggtaacggtcggttnttacttacggtccgggtacccggttccgggggaccgttacccgttcggaccctcccgtcccctacccacccgtaaccgaaccgtaacccgg

SEQ ID NO: 418563 - DNA, 708 bp, Homo sapiens
  misc_feature: GZ8MTXP01DQROE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtggaggaggcttgatccgagccgtgggggtccctgagactctcctgtgcagtctcgtggttcgtcgaggtggcgactacatgagcgtcgggtcccgcgacggctccggaggggaagggcctgggagtggatcctctactttatttagtaggtggtacgtaccccactactactacacgaaacgtactccggtagaacggggtaccctattaccgacctagtacctacgaagaaacggtaactaacgttaccgaaggtaaacctacgttaatttacgtaacttacttaactaaacgtacgtaaacgttaaccgtaggaacggaacggaccggaacggaccgaccggaacctagttacgttaagttacgtggtgggttcggggttacttacgttttaccgtcggtaccccgggttcgggggttccccgggttaacccgttcggtcccgtaaccccgttccccgacccccgttacccctaacccgaacccggtaaccccggg

SEQ ID NO: 418564 - DNA, 719 bp, Homo sapiens
  misc_feature: GZ8MTXP01BGOBP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgacgactctcctgtgcagtctcgtgggttcgtcagtggcgactacatgagcgtgggtccgcaggccgtccgagggacgggcctggagtggatctctactttatttagtagtggtcggtaccccacatacctacacaaacgacctcgtagaacggggcctacgttacacctatcctacaagtaaacgaactaaattcccaaaggaaacctataagttataactcttaaactaaattacggtaaaacttaacccgtaggaacgaacgggacccgaaacgggaccgaaccgggtacccctaagttacggttaactttaccgttgggttcggggtacgggggttactttaacgtttttacccgtacccgggtaacccccggggtttccgggggaccccgggggttaaccccgttcgggttcccgtaaccccgttccccggttaccccccacccccgttaacccgaaaccccggtaacccgggg

SEQ ID NO: 418565 - DNA, 629 bp, Homo sapiens
  misc_feature: GZ8MTXP01AH50T.21.78.H01.1.454.CMB.2.raw
  modified_base (294)..(294): a, c, t, g, unknown or other
  modified_base (438)..(438): a, c, t, g, unknown or other
  modified_base (460)..(460): a, c, t, g, unknown or other
  modified_base (471)..(471): a, c, t, g, unknown or other
  modified_base (477)..(477): a, c, t, g, unknown or other
  modified_base (533)..(533): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggtttttccttgttgcttatttacaaaaggtgtccagtgtgaggtgctaggttggtggagacgtgggaggaggcttgactccgaggtccggtgggggtccctgacgtacctctcctgtgctgtctgtgggtctcagtggcactanatgagcgtcgggtccaccgaggcctaccggaaggggaacggggccgtggagttgggactactctactttattagtaggtcggtagtaccccatatacaacacgaaagcctccgtagaaacgggcctatcaccatcacaagtaanactaatccaagaacatattatntaccgttaaanaataanaaactacgagacgacgaccggacgtacgacgactaagtgttacgtagtggtaaggnggttacttaccgttaccgtccggtccccggggttcggggccggttacccgtgtcccgaacccgtccccaccccgttacccaaccgaacccggtccg

SEQ ID NO: 418566 - DNA, 742 bp, Homo sapiens
  misc_feature: GZ8MTXP01BUGAM.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgactccgagccgtgggggtccctgagactctcctgtgcagtctcgtgggttcgtcgaggtggcgactacagtgacgtcgtcgggtcccgccgacggcctcccggaagggggaacggggcccgtagggaaggtgggacttccgttactaacgttttatttaagtacggttcgggtacggtaacccccaactataacctaacacgtaaacggtacctccggtaggaaacggggcccgtattaccgactattcacaaggaaactactaattacccgaagaaacctactaagtttctaacttaccttagaaaatagaaacttaaccgaggacgaacggacccggaaggaccgaaccggtcctagttgttaaacgttcggtggttcgggttacggggacctttaaaggtttcccgttaccggtcccccgggggttagggggcccccgggggttaaacgttcccgggtacccgtaaccccggttcccctaccccccttacccgttaacccgaacccggtaaccccgggg

SEQ ID NO: 418567 - DNA, 754 bp, Homo sapiens
  misc_feature: GZ8MTXP01DG9SM.21.78.H01.1.454.CMB.2.raw
  modified_base (277)..(277): a, c, t, g, unknown or other
tcagtcgtcgctcgcacgaccggtgctcgatttagtgtgagtagtttgggtttgggggggagaggagcccagcactggggattccgaggtgtttccattcggtgatcagcactgaacacagaggactcaccatggagttttggctgagctgggttttccttgttgctattcaaaaggtgtccagtgtgaggtgctagttggtggagacgtgggagggaggcttgatccaggccgtgggggtcctgacgactctctgtgctagtctcgtgggttcgcnggtcggcgactactatggacgcgtcgggtcccgcgacggcgtacccgaaggggacggggcctagggagtcggacttcttactactttatttagtacggttggtacggtaacccccactaaactactaaccacgtaaacgtaccgtcggttaggaaacgggtcccgtacttaccacctatcctacaaggtaacaaacgtacttaccgaaaggtaaacctacttagttacgttaacttacttaaccgtaaaataacggttaaacttaaaacccgttggaaacggacggaaacccggaacggaacaccggggtacctaaggtcgtttaaacgttacgtgggttaacgggtgggggttaccttacggtttcgttacggggcccccgggttaggggggttccccgggttaacccgttccgggtaccccaacccgtttccccgaacccccgttaccccgtaacccgaacccgggtaaccccgg

SEQ ID NO: 418568 - DNA, 704 bp, Homo sapiens
  misc_feature: GZ8MTXP01ELZ2D.21.78.H01.1.454.CMB.2.raw
  modified_base (483)..(483): a, c, t, g, unknown or other
  modified_base (665)..(665): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggttggtgggagacgtgggaggaggtcttgactccgagccggtggggggtccctgagactctcctgtgcagtctcgtgggttctcgaggtggcgatacagtgagcgtcgggtcccgccgaggcctacccggaaggggaacggggcccttagggggaggtggaattcccgtctaactttattttaagtaggtggggtacgtaaccccacgtatacctacactaacgaaccgtcggtaggaaacgggcctattcacctatcctacagtaagactaatccaaggaaaccntaattagtaacttctaacaaagtacgaaacttaactaggaagacggacggaacggaacgacggacctagttagtattacgttggtaaggttcggggattacgttttaccgttaccgggaaccccggttacggggggccccggggttaaccccgtcgggttacccgtaaccccggtttacccnccccccggttaccctaaccccgaacccgggtaaccccgg

SEQ ID NO: 418569 - DNA, 774 bp, Homo sapiens
  misc_feature: GZ8MTXP01C63NP.21.78.H01.1.454.CMB.2.raw
  modified_base (276)..(276): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgaggccgtgggggtccctgacgctctcctgtgcagtctcgtgggttcgtnagtggcgactacatggacgcgtcggggtccccgccgacggtccgtaccggaagggggaacggggcccgtagggaggtacgggtactttcctacgttaacttttaagttttaagttaggttcgggttacggtaaccccctaactaactaacttaaccaacgtaaaccgtaccgtcccgggttaggaaaccgggggtccctaacttaccgaaccctattacctacgaacgaaacggaactaaacgttccgaaaggtaaaccattattacgtattacttaacaaaagttcgtaaacgttaaacgtgaaacggaacgccgaaacggaccacggtacctagttagttacttacgtggtgggttcgggcttaaacgtttccggttacccgggtaaccccggggttcggggggttacccccggggttaaccgtttccgggtaacccgtccccgttacccccgtacccccccgttaaccgtaacccccgaaccgggtaaccccggg

SEQ ID NO: 418570 - DNA, 805 bp, Homo sapiens
  misc_feature: GZ8MTXP01DZYMV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagtttggctgagcttgggttttccttgttgcttatttacaaaaggtgtccagtgtgaggtgcgaggttggtggagacgtgggaggaggcttgatccagccgtgggggtccctgagactctcctgtgctagtctcgtgggttcgtcgaggtggacgactacatggagccggtcgggtccccgcgaggccgtacggaagggaggggcctggagtggattctcgtaactttatttagtaggtggtacgtacccactagtaactaacacgaaacgaccgtcggtaggaaacgggcccgtaaacttccaacctaatctacgaaagaaaagaacctaaacgttacccgaaaacgggaaacctacgtaatttacgttaaacttactttaaaccaaaagttacggtaaaacgttaaacccgttagggaaaaccgacgggtaaacccgggaaacgggaaaccgtaacccgggtaaccttaggtttaaccgtttaagtttaaaccggttgggttaagggttacgggggttaacttaacccggtttttaacggttaccccggtaacccccgggggtttcggggggggaacccccgggttaacccgttggggtaacccctaacccccggtttaccccgcccccccttacccccggttaaccaaaccccggggttaaccccggg

SEQ ID NO: 418571 - DNA, 703 bp, Homo sapiens
  misc_feature: GZ8MTXP01CO3WA.21.78.H01.1.454.CMB.2.raw
  modified_base (584)..(584): a, c, t, g, unknown or other
  modified_base (653)..(653): a, c, t, g, unknown or other
tcagtcgtcgctcgcacgaccggtgctcgattttagtgtgagtagtttgggtttgggggagaggagcccagcactgggattccgaggtgtttccattcggtgatcagcactgaacacagaggactcaccatggagttttggctgagcgttgggtttttccttgttgctatttcaaaaggtgtccagtgtgaggtgctagttgggtggagacgtggaggaggcttgatccgagccgtcgggggtccctgagactctcctgtgctagtctcgtggttcgtcaggtgcgactacagtgagcgtcgggcccgcaggcctccggaagggacggccgtaggagtggacttcttacgactttagtttagtggttggttcgtaacccccatataacctacacaacgtaaccgttccgtaggaaccgggctaacgttccacctatccgtacaagaaagactaaacttacccgaagtaaaccacttagtttacgtaacttacgttaacaaagtacggtaaacttaccgtagacggaaccgcgggaaacgcccgacgggtaccctagtcgttaattacggtacgtgggttacggngtttaacgtttaccggtaccgtaccccggggttcggggggttcccccggttaaccgtcgggttaacccncccgtttacccctccccccgaaccccgttcccgaaaacccggtccccggg

SEQ ID NO: 418572 - DNA, 720 bp, Homo sapiens
  misc_feature: GZ8MTXP01B8QKR.21.78.H01.1.454.CMB.2.raw
  modified_base (247)..(247): a, c, t, g, unknown or other
  modified_base (564)..(564): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagactgggaggaggcttgatccgagccgtgggggtccctganactctcctgtgcagttcttcgtgggttcgtcaggtcggacgaactacgatggagcgtgggtcccgcgaggcctaccggagggacggccgtggacgtggatctactactttattactagtggtacggtacccctaacgataccgtaacacaaacggtacctccgggtaggaaaccggggtcctaacgttccgaaaccctatacccgtacaaaggaaacaccgtaaactttacccgaaggtaaacacttaagttattactattaaacaaatagaaacgtaaccgttagagtaacggacggaacggaaccacggtaaccngttaacgttaacttacggtaggtggtacgggttaccgttaaattttcccggtaacggtaccccgggtttacggggggaccccgggttacccgttcgggtacccaacccggttccctacccccgttaacccgttaaccccgaaccgtaaccccgggg

SEQ ID NO: 418573 - DNA, 728 bp, Homo sapiens
  misc_feature: GZ8MTXP01EE1JC.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgtagttggtggagacgtgggaggaggtcttgactccgaggccggtcgggggtccctgacgtactctcctgtgcagtctcgtgggttctcaggtggcgactacatgacgcgtcgggtcccgcgaggcctaccggaaggggaacgggccgtagggacggtgggtacttccttactaactttaatttagtaggtggtacgtaaccccactactaactacacaaacggacctccggagaaacggggcctattaccaaccgtatctacgaagaaacactaaacttccgaagtaaaccattaattcgtaacttaccttaaacaaaattacggaaacttaaaccgtggaaacgacggaccggaaacggaaccgacggaccctaagttcgttaagttacgtaggtgggttacggggttattaaacgttttcgtaccggacccccggggttcggggggttaccccgggttaaacccgtcggggttaccctaaccccggttcccctacccccgaacccttccccgaaccggtaaccccggg

SEQ ID NO: 418574 - DNA, 749 bp, Homo sapiens
  misc_feature: GZ8MTXP01EAY3R.21.78.H01.1.454.CMB.2.raw
  modified_base (603)..(603): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggtttttccttgtttgcttatttacaaaaggtgtccaggtgtggaggtgcgtaggttggtggagacgtggaggaggcttgatccgagccgtgggggtcctgagtactctcgtgtgctacgtcttcgtgggttcgcgtaggtcgcgaactacagtgagtcgtcgggtcccgcgacggccgtacgaggggaacggccgtgggagtggtactctacgttactttagtttagtacggttggtacgtaaccccaactattaacctacaacgtaacgtaccttaaccgggacgggtaaaccgggacccgtaacgttaccaacctattaccgtaacgaaacgaaacgtactaaacgtaccaaaggtaaacctaacttagtttaatacttacctaaagtaaaatacggtaaaactacccgttaaggaacgaacggacccgaaggaaccgcgaaccgtntacgttaattcgagggttcgttacggggacttacgtttaccgttacccgggacccgggttccggggacccggggttaaccccttcgggtaccccgtccccgttacccggcccccttaacccctaaccccggaacgtaacccccggg

SEQ ID NO: 418575 - DNA, 770 bp, Homo sapiens
  misc_feature: GZ8MTXP01CLRRT.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccgacggtccggttcggggggtccctggacgtacctcctccgtgtcgctacgtcgttcgttgggttcgtcgaggtcggcgaactacagtggacgccggtcgggtccccgcgacggccgtaccggaggggaacgggccgtgggagtggtactctacgtacgtttatttagtaggtggtacggtaaccccactatacctacacgaacgtacctccggaggaaccgggcctattccgacctactacctacgaaagaacgaactaacttaccgaaggtaaacctactagtttacgtacttaccttaaactaaattaacgtaaaccttaacgtaggaacgaacggtacccggaacggaaccgtaccggtaccgtaagtttagtaactttacggtgggttaacgggtcggggttctttaacgttccggttaacccgggtaccccggggttcccggggggccccggggttaacccggttcccgggtaccccgtaaccccggttcccctacccccccgttacccgtaacccccgaacccggtaacccccgggg

SEQ ID NO: 418576 - DNA, 806 bp, Homo sapiens
  misc_feature: GZ8MTXP01ASFAZ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtggaggaggcttgatccgagccgtgggggtccctgagactctcctgtgcagtctcgtgggttcgcagtggcgactacatggagcggtcgggtcccgccgacggcctacccggaggggaacgggccgtagggagttcgggactcctactaacttttagtttaagtaggttcggtacggtaaccccactaacgtaactacacgaaacgaccgtccggtagggaaacgggccgtacgttccaaccgtatcctacgaaagaaacgtaactaaacgttacccgaaaggaaacctacttaaacgtttagttaaacttaccttaaacgtaaaattacggtaaaacttaaacccgtagggaaacggaacggacccggaaacgggaccgaaccgggtaacctagttaacgggttaactttaaccgggttgggttaacgggtacgggggttaccttaaacggtttttaaccccggttacccggggtaacccccggggttaccgggggggttaccccggggttaaaccccggttcgggtaccccgtaaccccggttcccctacccccccggttaccccctaacccgaaccccgggtaaccccgggg

SEQ ID NO: 418577 - DNA, 714 bp, Homo sapiens
  misc_feature: GZ8MTXP01CUUVM.21.78.H01.1.454.CMB.2.raw
  modified_base (196)..(196): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagtttggctgagcttgggttttccttgttgcttatttacaaaaggtgtccagtgtgaggtgnagttggtggagacgtggaggaggcttgatccgagccgtcgggggtccctgagactctctgtgcagtctcgtgggttcgtcagtggcgactacatgagcgtcggtccgccgaggcctccgagggaacgggccgtggagtggatctctactttattagtagtggtacgtaccccactatactaacacaaacgactccggtagaaacggggccgtataccacactactacaagaaacgaactaacttaccgaaaggaaacacgtattagttacttacttaacaaaatagtaaactaaacctaggaagtaacgggaccggaaacgggaaccgaaccggtaacccgtaagttagttaacgtttaaccgttgggtaagggttcgggggactttaacgtttacggtttacccggtaccccggggttaccggggggttccccggggttaaacccggttcgggtaaccccgtccccggttccccgtacccccttaaccccgttccccgaaaccccggtaaccccggg

SEQ ID NO: 418578 - DNA, 837 bp, Homo sapiens
  misc_feature: GZ8MTXP01DQAJ8.21.78.H01.1.454.CMB.2.raw
  modified_base (801)..(801): a, c, t, g, unknown or other
  modified_base (811)..(811): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcgtagttggtggagacgtgggaggaggcttgactccgacggtccggtcgggggtcctgacgtactcgtcgtgtcgcgtacgtcgttcgtcgggttcgtacgtaggtcggacgaactacagtggaacgtcggttcgggtccccgacgacggccgtaccgggaaggggaacgggtccgtagggtaaggtcgggtacttacctttacgttaacgtttttaagtttaacgttaagggttcgggttacggttaaaccccctaacgtaaacttaacccgtaaacctaaccggtaaaaccggttaacccgtttaacccggggtaaacgggtaaacccgggggtaccccgttaaacgtttacccaacctaacgttaccctaaacgaaaggtaaaccggtaaacctaaacgtttaaccgaaagggtaaaacctacgttaagtttacgttaacttaaccgttaaacgtaaaagttacgtaaaacgttaaccgtaggaaacgacggaaccggaggaaccgtacgaaccttagttacggttaatcggtggtaacgggttggttacttacgtttacgtcggtaccggttcgggggttacccgttacgtccgtaccncccgttcccncccgaccctaaccgaaccgtaacccg

SEQ ID NO: 418579 - DNA, 702 bp, Homo sapiens
  misc_feature: GZ8MTXP01E46AO.21.78.H01.1.454.CMB.2.raw
  modified_base (491)..(491): a, c, t, g, unknown or other
  modified_base (653)..(653): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcaggttggtggagactggaggaggcttgactccgagccggtgggggtccctgagtactctcctgtgctagtcttcgttgggttcgtgaggtggacgactacatgacgcggtcggtcccgccgaggcctaccggaaggggaacgggtccgtagggaggtcggtactacttactaactttatttagtaggtgggtacgtaaccccaactataacctacgacaacggtaaccgtcggtaggaacgggccgtactacccgactactctacaaggaaactactaactacccgaagaaaccntattacgtactacttaaacaaattagaaaacttacgaggaacgacgacgaacgggactaccgggactaagtacgtaagtcgtaggtcggtagggttcttaacgttttacccggaccgggtccccggttacggggggttaccccggttaaccgtggttacccnccccgttaccccgaccccttaccccgggaacccaaccgggtaaccccgg

SEQ ID NO: 418580 - DNA, 657 bp, Homo sapiens
  misc_feature: GZ8MTXP01DQI70.21.78.H01.1.454.CMB.2.raw
  modified_base (303)..(303): a, c, t, g, unknown or other
tcagtcgtcgctcgcacgaccggtgctcgatttagtgtgagtagtttgggtttggggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtgggaggaggcttgatccagccgtcgggggtcccagactctcctgtgcagtctcgtgggttcgtcagtggcgactacatgagcgtgggtccnccgaggctccgaggggaacggcctgggagtggatctactacttatttataggtgtacgtaccacatactacacagaacctcgtggaacgggccgattccacactctacaagtaagactaacttaccgaaggaaacactaatttgtaacttcttacaaaatagtaaactaaccggtgaagacgaccgaaggaaccacggcctaagttgtaacttacgtgtgggtaaggggtcttaacgttttacgttccggtaaccccgggtcgggggttaccccgggttaacccttcgggtaaccccacccggttcccctaccccccgtacccgttaccccgaacccgaaccggggtaaccccc

SEQ ID NO: 418581 - DNA, 647 bp, Homo sapiens
  misc_feature: GZ8MTXP01B1U52.21.78.H01.1.454.CMB.2.raw
  modified_base (198)..(198): a, c, t, g, unknown or other
  modified_base (542)..(542): a, c, t, g, unknown or other
tcagtcgtcgctcgcacgaccggtgctcgatttagtgtgagtagtttgggtttgggggggagaggtgcccagcactgggattccgaggtgtttccattcggtgatcagcactgaacacagaggactcaccatggtagttttggctgagtcttgggttttccttgttgcttattacaaaaggtgtccagtgtgaggtgntaggttggtggagacgtgggaggaggcttgatccgaggccgtgggggtcctgagtacctctcctgtagctagtctcgtgggttcgtcaggtggacgactacatgagcgtcgggccgacgacggctaccggaaggggaagggccgtaggagtggtactctactatttattataggtggtacgtaccacaatacaacacaacactccggagaacgggacctactacacctaatcccagaagaaacaacaacttaccgaaggaaaaccattaattataatacttaaggaaaattacaaataaacgtgaacggacaccgagacctaacgactatagtaattcgtaggnggttcgggacttaacgtttacgtaccggacccgggttacgggggacccgggttaacccttggcccgaacccttcccaccccgaccctaaccgaaccgtaacccgg

SEQ ID NO: 418582 - DNA, 718 bp, Homo sapiens
  misc_feature: GZ8MTXP01DZOS6.21.78.H01.1.454.CMB.2.raw
  modified_base (198)..(198): a, c, t, g, unknown or other
  modified_base (309)..(309): a, c, t, g, unknown or other
  modified_base (555)..(555): a, c, t, g, unknown or other
  modified_base (575)..(575): a, c, t, g, unknown or other
  modified_base (595)..(595): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagagtactcaccatggtagttttggctgagtcgttgggttttccttgttgtcttatttacgaaaggtgtcagtgtgaggtgngtaggttggtggagacgtgggaggaggtcttgactccgaggtccggtcgggggtcctgacgtacttcgtcgtgtcgctacgttcgttcgtggttcgcgtaggtgacactanagtgacgtcggtcgggccgtcgacggccgtacgggaaggggacggtcgtaggtaggtaggtacttcttacttaatttagtttaacgtaggttacggtacgtaaccccactataaccgtaactacgtaaaccgtaccgttaaccgggtaggaaccgggtaccttacttacccactacgttacaaacggaaagtaaacctaacctacgttaacgaaagttaaactcgtttatttacgatttaactaanaaagttacgaaacgttacgnggaacgacgacccgggtaanacgactattagttacgttacgtggtcgggtaaggtcgttaactttcggttaccgggacccgggtccggggacgggttacccgttcttccgccctccctccccgacccaccgtccgaaccgtcg

SEQ ID NO: 418583 - DNA, 749 bp, Homo sapiens
  misc_feature: GZ8MTXP01AIXS6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaggtgtccagtgtgaggtgctaggttggtggagacgtggaggaggtcttgactccgacggtccggtcgggggtccctgacgtactcctctggtgctacgttcttcgttgggttcgtcgtaggtcggacactacagtggacgtccgtcgggtcccgcgacggtccgtacgggaaggggacggcgtaggaggtgacttcctacgttactttagtttagtagttcggtacgtacccctacgtataccgtaacacgaaacgtacccgtaacggtaggaaccgggtaccgtacttaccgacctacgtacctaacgaacggtaaacaaccgttaacgtaccgaagtaaaccacgttattacgttattacttaaacaattaacgtaaacgtacgtaagaacggacgtaaccggaggaccgacggtaaccttagttgttaattacggttgggtaacggtcggggttactttacgtttacccgggtacccggtcccggggacccgggggttaccgacccggttcggtcccgtcccgttaccccgacccccttaccccgtaacccgaacccggtaacccgg

SEQ ID NO: 418584 - DNA, 675 bp, Homo sapiens
  misc_feature: GZ8MTXP01EKFKK.21.78.H01.1.454.CMB.2.raw
  modified_base (204)..(204): a, c, t, g, unknown or other
  modified_base (542)..(542): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttattacaaaaggtgtccagtgtgaggtgcaggttggnggagacgtgggaggaggcttgactccgaggtccggtcggggggtccctgacgtactctcctgtgctagtcttcgtgggttcgtcgaggtggcgactacatgagcgtgggtcccgcgaggctcggagggagggccgtagagtggatctctactttattagtagtggtacgtacccactataactacacaacgtacctcggtaggaaacgggcctacttccaactactctacaagaacacaacttaccaaggaaactacgtattacgtactactaacaaatcgtaaacgtaaccgtagaacgacggaccgaacggaacgacgacctagtgtaacgttcgnggtggtgggttaccttacgtttaccgtaccgggtccccgggttacggggggttccccgggttaacccgttcgggtaccccgtaacccgtcccccgtaccccgaccccgttaaccccgaaccggtaaccccggg

SEQ ID NO: 418585 - DNA, 840 bp, Homo sapiens
  misc_feature: GZ8MTXP01BSL9N.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgtcttattacaaaggtgtccagtgtgaggtgctaggttggtggagacgtgggaggtaggtcttagactccgacggtccggttcgggggtccctagacgtaccttctccgtgtcgtcgtacgtccgttcgttcggggttccgtacgacggtcggaccgtaactacgagttggacggtccggtccggggtcccgccgacggtcccgtaccggggaagggggaacggtccgtagggggtacgtgggtacttccgttactaacgttttagtttaagtggtcggggtacgtaacccctacgtatacctacgacgtaaccgtaccgtccggtagggaaaccggggtacctactttaccaactctacgtactaaagtaacgtaacgtaactaccggaacgtaaactacttacgttagtaacttactaactaaagttacgtaaacggtaaccgtaggtaaacgaccgggtaaccgacgggaaaccgtaccggtaccgttaagttacggttacgttaacggttcggtaagggttcgggggttactttacggttttaacccggtcccggggtaaccccgggttacccgggggggttaccccggttaacccggtccgggtaccccgttccccgtaccccccgtaccccgttacccccgttaacccgaacccgggtaacccccggg

SEQ ID NO: 418586 - DNA, 753 bp, Homo sapiens
  misc_feature: GZ8MTXP01BT6XE.21.78.H01.1.454.CMB.2.raw
  modified_base (513)..(513): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaggtgtccagtgtgaggtgcgtagttggtggagacgtgggaggaggtcttgatccgacggtccggtcgggggtccctgacgacttctccgtgtcgctagtcttcgtgggttcgtcgaggtcggcacgtacagttacggacgtcgtcgggtcccgaccgtacggccgtaccggaagggacgggtccgtggacgtaggtactcttacgtacgtttagtttacgtacggtacgggttacggtaaacccctactaacttaaccgtaacgaaaccgtaaacgtaacccgttccgggtaaggaaacccggggtacctacgttaccaacctattacccgtanaaaggtaaaccgtaactaacttaccgaaaggtaaacctacttaagttacgtaacttacttaaacaaagttacgtaaactaaccggtgaaccgtaacggacgacggaccgacggtacctagtacgttcttaacgtggttaacggtcggttactaacgtttcgacccggtaccgggttcggggacccgttaccgtcgccctaacccttccccacccgttaccctaaccgaacggtaaccccg

SEQ ID NO: 418587 - DNA, 801 bp, Homo sapiens
  misc_feature: GZ8MTXP01DMVUQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagtcttgggttttccttgttgcttatttacaaaaggtgtccagtgtgaggtgctagttggtggagacgtgggaggaggtcttagactccgacggtccggtcgggggtccctggacgtacttcctccgtgtcgctacgttccgttcgttgggttcgtcgtaggtggaccgaactacgatggacgtcggtcggggtcccgcgacggcctaccggaggggaacgggccgtagggagttacgggactttccttacgttaactttagttttagttacggttagggttaccgttaaccccaacgtaattaaccgtaaccaacgtaacggtacccgttccggtaaggaaacgggtcccgtaacttaccgacctataccgtacgaaagtaaacaaacctaacttaccgaaaggtaaacctattaacttagttaacttacttaaacgaaaattacgaaaacgttaacccgtaaggaacgaaccggaccggaacggacccgaacgtaccgtaacgttagtttacgttacgtggttggtacgggttactttaacgttaccggttaccgggaccccggggttacgggggaccccggttaacccgtccgggttacccaaccccgttccccgaccccgttaccccgtaacccgaaccccggtaacccggg

SEQ ID NO: 418588 - DNA, 693 bp, Homo sapiens
  misc_feature: GZ8MTXP01EB761.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttggggttttccttgttgctatttacaaaaggtgtcagtgtgaggtgcgtagttggtggagacgtgggaggaggcttagatccgagtccggtgggggtccctgagtactctccgtgtcgctagtcttcgtcgggtcgtctaggtcgacactacagtgacgcgtcggtccgcgaggccgtacgggaaggacggccgtaggtaggtgtactctatactttagttagtaggtaggtacgtaccccactactaactacacgaacgtcgtcggtaagggaccgtacgtacttacccaacgtatacgacgtaagaacaactataccgaaagtaactcttagtatacttataacgaaatacgaaactcgtagaacgtaggaccgagacgccgtaatagtagttacttacggtcggttaaggtacgggttattccgttttaaacgtccccggggtacccggggttacgggggaaccccggtttcccgtaaccgggtcccttaaccccgtaccccgtacccccttaccggaaacccgttaacccggtaacccggg

SEQ ID NO: 418589 - DNA, 709 bp, Homo sapiens
  misc_feature: GZ8MTXP01ES4H1.21.78.H01.1.454.CMB.2.raw
  modified_base (448)..(448): a, c, t, g, unknown or other
  modified_base (505)..(505): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcgttcgggttttccttgtttgcttatttacgaaaaggtgtccagtgtgaggtgcgtaggttggtggagacgtggaggagtcgttgacgtccgacgtccggttcgggggtccctagacgtactctccgtgtcgtcgtacgttcgtcgtgggttctcgaggtggcgactacagtgagtcgttcggccgcgaggcgacggagggacggcgtaggagtgtactctacttagtttacgtttgtaggtcggtacgtaccccacgtaactacgacacgaacgcgtcggaggacggccgtactcacncgttacacgaagtaacactacgttacgaagtaaacctatagttacgtattacctaanaaagttaacgaacgttaacgaggacgacggacggtaacgaccgacggtactaggttataccgttagtggtaacgggttacgcttacgttttacccggcccggtacccgggggttcggggttaccccggttaaccgttccggtaaccccgtaaccccgttccccgttaacccccgaccgttaaccccggaacccggaaccccggg

SEQ ID NO: 418590 - DNA, 800 bp, Homo sapiens
  misc_feature: GZ8MTXP01AIUTF.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtggaggaggcttgatccagccgtgggggtccctgagactctcctgtgcagtctcgtgggttcgtcaggtggcgaactacagtggacgtcgtcggggtcccgccgacgggcctacccggaagggggtaacggggccctgggggaggtgggacttccttactaacttttagtttagtagggttgggttacggtaacccccactataacctaaccaacaaacgtacccgttcccgggtagggaaaccgggggtccctaatttcccgaacctacttacccgtacaaagggaaacgtaacctaaacgttccccgaaagggtaaacccaacttatttagtaacttacctttaaacaaaagttaggaaacttaaccgtaggaacggaaccggacccggaagggaaccaccgggaccctaagttaggttaactttacgtgggttcgggtggggttaccttaacggtttttacccggtcccgggtacccccgggttggggggggacccccggggttaaacccgttccggggtacccctaaccccggttccccctaccccccccgttaacccgtccccgaaaccccggttaaccccggggg

SEQ ID NO: 418591 - DNA, 706 bp, Homo sapiens
  misc_feature: GZ8MTXP01DU563.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtcggcgactacatgagcgtcgggtccgccgaggctccgaaggggaagggcctgggagtggatcgtctactttatttagtagtggtacgtaaccccacgataactacaacaaagacctccggtagaaacggggcccattaccaaccatctacaagaaacgaactaaacttccgaaaggaaacctactaaatttggtaaactctttaacaaaattcggaaacttaaacccgtgaaacgacggaccgaacgggaacaccggaaccctagttagttaaacgttacgttaggttaaggtcgggggttacttaacgttttaccgttaccggacccccgggttacggggggttccccggggttaaaccccgtcgggtaccccgtaaccccggttcccctaccccccgaaccccgttccccgaacccgtaaaccccgggg

SEQ ID NO: 418592 - DNA, 564 bp, Homo sapiens
  misc_feature: GZ8MTXP02GT4XR.21.78.H01.1.454.CMB.2.raw
  modified_base (296)..(296): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccnccagggctccgaggggaagggcctggagtgggatctcactttatttatagtggtggtaccccacatactacacagactccgtgaagggccgattccacatctcagaagacaattccaaggaaacacattgtatcttacaaaatgaaataacctgagagaccgaggacacggccatgtaattacgtgtggtggggctacgtttacttcgaccccgtgggggcccggggaaccgtggtccaccgtccgtccccaccctccaccgaaccgg

SEQ ID NO: 418593 - DNA, 569 bp, Homo sapiens
  misc_feature: GZ8MTXP02F919L.21.78.H01.1.454.CMB.2.raw
  modified_base (409)..(409): a, c, t, g, unknown or other
  modified_base (437)..(437): a, c, t, g, unknown or other
  modified_base (443)..(443): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttccttgttgctatttcaaaaggtgtccagtgtgaggtgcagttggtggagactggaggaggcttgatccagcctgggggggtccctgagactctcctgtgcagtctctgggttcgtcagtggcgactacatgagctggggtccgccagggctccgaggggaagggcctggagtgggatctcactttatttatagtggtggtaccccacatactacacagactccgtgaaaggggccattcaccatctcagaaanacaatacaagaacatattagtatactanaaatanaaataactgagacgacgagacacgcatgtatagtgtggtgggtactactttacgtcgacccggtcgggggacccgggtaaccgtcggtaccaccgtccctacccccaccctacccgaaccgaacgg

SEQ ID NO: 418594 - DNA, 561 bp, Homo sapiens
  misc_feature: GZ8MTXP02F8UEJ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcactttatttatagtggtggtaccccacatactacacagactccgtgaaagggccgattcaccatctacagaagacaattccaaggaacacattgtatacttacaaatagaaataacctgagagaccgaggacacggccatgtattactgtgtggggcagtttaacttcgaccccgtgggggcccggggtaaaccctgggtcaccggtcctccccaccctccaccaaccggg

SEQ ID NO: 418595 - DNA, 565 bp, Homo sapiens
  misc_feature: GZ8MTXP02HRH9H.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtccgccaggctccgaggggaaggcctggagtggatctcactttatttatagtggtggtaccccacatactacacagactccgtgaacgggccgattcaccatctcagagacaatccagaacacattgtatcttacaaatagaaataacctagagagccgagacgacggcatgtattactgtgtggggctacgtttacgttcgtacccgtcggggcccggggtaacccgtcggtccgaccggtccctacccccgaccctcccaccgaacccgg

SEQ ID NO: 418596 - DNA, 567 bp, Homo sapiens
  misc_feature: GZ8MTXP02F5MPW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccagggctccaggggaaggggcctggagtggatctcactttatttatagtggtggtaccccacatactacacagactccgtgaagggccgattcaccatctcagaagacaattccaggaacacattgatcttacaaaatgaaataacctgagagccgagacacggcatgtatactgtgtggggctagtttacttcgaccccgttgggggcccggggtaaacccgtggtaccgaacccggtcctacccccacccgtcccaccgaaacccgggg

SEQ ID NO: 418597 - DNA, 532 bp, Homo sapiens
  misc_feature: GZ8MTXP02IYA52.21.78.H01.1.454.CMB.2.raw
  modified_base (449)..(449): a, c, t, g, unknown or other
  modified_base (473)..(473): a, c, t, g, unknown or other
  modified_base (516)..(516): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtggatctcacttatttatagtggtggtaccccacatactacacagactccgtgaaagggccattcaccatctcagaagacaattccaaggaacacaattgtaatcttacaaatgaaataacctganagccgagacacggccatgtatacngtagtgggcattactgaccctggggccggaacctggcacgtcncccacctccacaacgg

SEQ ID NO: 418598 - DNA, 572 bp, Homo sapiens
  misc_feature: GZ8MTXP02GY64F.21.78.H01.1.454.CMB.2.raw
  modified_base (398)..(398): a, c, t, g, unknown or other
  modified_base (483)..(483): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatcgtcacttatttatagtggtggtaccccacatactacacagactccgtgaaagggccgattcacatctcanaagacaattccaagaacacattgtatcttacaaaatgaaaataaccctagaagagacccgaaggacacgggccatcgtaattacngtgtggggactatttacgtcgaccccgtgggggcccgggaaccctgggtccaacccgtccgtacccccaccctcccaaccgaacccggg

SEQ ID NO: 418599 - DNA, 551 bp, Homo sapiens
  misc_feature: GZ8MTXP02JXDWR.21.78.H01.1.454.CMB.2.raw
  modified_base (358)..(358): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggcctggagtggatctcacttatttatagtggtggtaccccanatactacacagactccgtgaaggccgattcaccatctcagaagacaatccagacacattgtatctcaaatgaaataactgagagccgagacacggcatgtatactgtgtggggctacgtttacttcgacccgtcgggggacccgggaacccgtggtccaccggtcctcccccgaccctcccgacctaaccggg

SEQ ID NO: 418600 - DNA, 609 bp, Homo sapiens
  misc_feature: GZ8MTXP02GH82Q.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccagggctccgaggggaagggcctgggagtggatctcactttatttatagtggtggtaccccacatactacacagactccgtgaaggccgattccacatctcagaagacaattcccaaggaaacacattagtatacttacaaaatgaaaataacctgagacgcgaaggaccacggaccatgtattacgtagtggtgggggactacgtttacgttcggtacccccgtcggggggaccccggggtaaacccgtcggggtacccgtaaccccggttccctacccccctaacccgtccccgaacccgaaacccgggg

SEQ ID NO: 418601 - DNA, 565 bp, Homo sapiens
  misc_feature: GZ8MTXP02GYCJQ.21.78.H01.1.454.CMB.2.raw
  modified_base (357)..(357): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggagggcctggagtggatctcacttatttataggtggtggtaccccanatactacacagactccgtgaagggccattccacatctcagaagacaatccaagaacacattgtatcttacaaatgaaataacctgagacgcgaagacacggccatgtatactgtagtggggctagtttacttacgaccccgttcgggggcccggggtaacccgtgggtacctacccggtcctcccccgaccctcccgaccgtaaccgg

SEQ ID NO: 418602 - DNA, 550 bp, Homo sapiens
  misc_feature: GZ8MTXP02IQS34.21.78.H01.1.454.CMB.2.raw
tcagtcgtcgctcgcacgaccggtgctcgatttagtgtgagtagtttgggtttggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctgggggggtcccctgagactctcctgtgcagtctctgggttcgtcagtggcgactacatgagctggggtccgccaggctccagggagggcctggagtggatctcacttatttatagtggtggtaccccacatactacacagactccgtgaaggggccgattcaccatctcagaagacaattccaggaacacattgtatcttcaaatgaaataacctgagagccgagacacggccaatgtatactgtgtggggcatttacttcgaccccgttgggggccgggtaaccctggtccaccggtctccccgaccctccaccgaaccggg

SEQ ID NO: 418603 - DNA, 608 bp, Homo sapiens
  misc_feature: GZ8MTXP02IKEU7.21.78.H01.1.454.CMB.2.raw
  modified_base (488)..(488): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccgccaggctccgagggaggcctggagtggatctcacttatttatagtagtggtaccccacatactacacagacctccggtgaacggggccattccgacatcctacagaagacaattcccaaggtaaacactattgtaatcttacaaatgaaatacctgactagaccgaggacacgggccaagtgtaattacgngttacggtggggactacttttaacgtcggtacccccgtgggggtccccggggtaaacccttggggtaccctaacccgggttccctacccccgacccgttaccgaacccgtaaacccgggg

SEQ ID NO: 418604 - DNA, 570 bp, Homo sapiens
  misc_feature: GZ8MTXP02GXPYV.21.78.H01.1.454.CMB.2.raw
  modified_base (478)..(478): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgaggggaacgggcctggagtggatcgtcactttatttatagtggtgtaccccacatactacacagactccgtgaagggccgatccacatctacagaagacaattccaaggaacactattgtatcttacaaatgaaataacctgacagccgagacacggcaatgtatacnggtggtgggctatttacgtcgaccccggtcggggacccggggtaacctggtcccacccggttccacccccgaccctcccgaaccgaacccgg

SEQ ID NO: 418605 - DNA, 550 bp, Homo sapiens
  misc_feature: GZ8MTXP02ITFQ2.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccgaggggagggcctggagtggatctcacttatttatagtggtggtaccccacatactacacagactccgtgaagggccgattcaccatctcagaagacaattccaaggaacacattgtatcttcaaatgaaataacctgagagaccgagacacggcaatgtatactgtagtggggctagtttactgaccccgtgggggcccgggaacctggtaccaccgtcctccccaccctccaccgtaaccggg

SEQ ID NO: 418606 - DNA, 576 bp, Homo sapiens
  misc_feature: GZ8MTXP02JPSAQ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaagggcctggagtggatcgtcactttatttatagtggtggtaccccacatactacacagactccgtgaacgggccgattcaccatctcaagagacaatcccaaggaacacgtattgtaatcttacaaatgaaataacctgagacgacgagacacggcatgtatactgtggtggggctaacgtttcgtacgtaccccgtgggggaccccgggtaccctgggtaccacccggttccctcccccacccgtccccaacgaacccggg

SEQ ID NO: 418607 - DNA, 557 bp, Homo sapiens
  misc_feature: GZ8MTXP02HWB8G.21.78.H01.1.454.CMB.2.raw
  modified_base (355)..(355): a, c, t, g, unknown or other
  modified_base (533)..(533): a, c, t, g, unknown or other
tcagtcgtcgctcgcacgaccggtgctcgattagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaaggcctggagtggatctcacttattatagtggtggtaccccanatactacacagactccgtgaaacgggccgattcaccatctcagaagacaattccagaacacattgtatcttacaaatgaaataacctgagagccgagacacggcatgtatactgtagtggggctacgtttacttcgaccccgtcgggggcccggggtaacccgtcggtccaccgtccncccccaccctcccaccgaacccgg

SEQ ID NO: 418608 - DNA, 547 bp, Homo sapiens
  misc_feature: GZ8MTXP02GKAMH.21.78.H01.1.454.CMB.2.raw
  modified_base (468)..(468): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtggatctcacttatttatagtggtggtaccccacatactacacagactccgtgaagggccgattcacatctcagaagacaattccaaggaacacattgtatcttacaaatgaaataactgagagccgagacacggcatgtatacngtgtgggctatttacttcgaccccgtgggggcccggggaacctgggtccaccgtcctccccacctcccaccgaaccggg

SEQ ID NO: 418609 - DNA, 553 bp, Homo sapiens
  misc_feature: GZ8MTXP02JIKIL.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccagggctccagggaagggcctggagtggatctcacttatttatagtggtggtaccccacatactacacagactccgtgaaagggccgattcaccatctcagaaagacaattccagaacacatagtatcttacaaaatgaaataacctgagagccgaggacacggccatgtattactgtgtggggcagtttactcgaccccgtcggggcccggggaacccgtggccaccgtctccccacccctccaccaaccggg

SEQ ID NO: 418610 - DNA, 581 bp, Homo sapiens
  misc_feature: GZ8MTXP02JJQA5.21.78.H01.1.454.CMB.2.raw
  modified_base (296)..(296): a, c, t, g, unknown or other
  modified_base (399)..(399): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccnccaggctccgagggaggcctggagtggatcgtcactttattatagtggtgtaccccacatactacacagactccggtagaaagggccgattccaccatcctanagaaagacaattcccaaggaacacaattgtaatcttacaaatgaaataacctgagacgacgaaggacacgggccaagtcgtaattactggtgtggggctaagtttcgtacgaccccgtgggggacccgggtaacccgtggtccaccggtccctccccgacccctacccgaccgtaacccggg

SEQ ID NO: 418611 - DNA, 542 bp, Homo sapiens
  misc_feature: GZ8MTXP02HMU6E.21.78.H01.1.454.CMB.2.raw
  modified_base (471)..(471): a, c, t, g, unknown or other
  modified_base (523)..(523): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactgggaggaggcttgatccagcctggggggtccctgagactctcctgtgcagtctctgggttcgtcagtggcgactacatgagctggggtccgccaggctccaggggaagggcctggagtggatctcactttattatagtggtggtaccccacatactacacagactccgtgaaagggccgattcaccatctcagaagacaattccagaacacattgtatcttacaaatgaaataacctgagagccgagacacggccatgtatacngtgtggggctatttacgtcgacccgtggggacccggaaccgtgtcaccgtcnccccacctccacgaaccgg

SEQ ID NO: 418612 - DNA, 606 bp, Homo sapiens
  misc_feature: GZ8MTXP02FWZYC.21.78.H01.1.454.CMB.2.raw
  modified_base (298)..(298): a, c, t, g, unknown or other
  modified_base (356)..(356): a, c, t, g, unknown or other
  modified_base (367)..(367): a, c, t, g, unknown or other
  modified_base (398)..(398): a, c, t, g, unknown or other
  modified_base (404)..(404): a, c, t, g, unknown or other
  modified_base (439)..(439): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtgggtttcctgttgctatttcaaaaggtgtccagtgtgaggtgcagttggtggagactggaggaggcttgatccagccgtggggggtccctgagactctcctgtgcagtctctgggttcgtcagtggcgactacatgagctggggtccnccaggctccgaggggagggcctggagtggatctcatttattagtagtggtgtacccanatactacacanactccgtagaacgggcctatccaacatccanaagaanaactaattccaagtaacactattacgtatacctanaaaatgtaaataacgtgacgacggaccgaacgacacggacctattagtaattcgtggtggtacgggtcttaagttacccgttgggacccccggttagggggaccccgggtaacctcgggtccctaacccggtccctacccccgacctacccgaacccgaaacccggg

SEQ ID NO: 418613 - DNA, 576 bp, Homo sapiens
  misc_feature: GZ8MTXP02GM0MY.21.78.H01.1.454.CMB.2.raw
  modified_base (406)..(406): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaacggcctggagtggatctcattattatagtggtgtacccacatactacacagactccgtagaacgggccgattcaaccatctacaagaaanacaaattccaagaacacattgtaatctacaaaatgaaaataacctgagagccgaagacacggcatgtattatggtagtggggtatacgtttacgtcgaccccggtcgggggacccgggtaacccgtcggtaccaacccgtccctacccccaccctacccaacgaacccgg

SEQ ID NO: 418614 - DNA, 583 bp, Homo sapiens
  misc_feature: GZ8MTXP02GZTXX.21.78.H01.1.454.CMB.2.raw
  modified_base (340)..(340): a, c, t, g, unknown or other
  modified_base (356)..(356): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaaggcctggagtggatctcactttatttanagtggtggtaccccanatactacacagactccgtgaaagggccgattcaccatctcagaagacaattccagaacacattagtatacttacaaaatgaaataacctgagagaccgaagacacggccatgtattactgtgtggggactagtttactacggtaccccgtacgggggcccggggtaaacccgtcgggtacccgacccggttccctacccccgacccctaccccgaccgaaacccggg

SEQ ID NO: 418615 - DNA, 571 bp, Homo sapiens
  misc_feature: GZ8MTXP02HEA0X.21.78.H01.1.454.CMB.2.raw
  modified_base (483)..(483): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctggggtccgccaggcctccgaggggaagggcctgggagtgggatctcactttattatagtggtggtaccccacatactacacagactccgtgaaggggccgattcaccatctcagaagacaatccagaacacattgtatcttacaaatgaaataacctgagagacgaagacacggccatgtatactgtgtggggntacgtttacttacgaccccgtacgggggcccggggaaacccgtcggtaccgaccggtccctcccccaccctacccacccgaacccggg

SEQ ID NO: 418616 - DNA, 553 bp, Homo sapiens
  misc_feature: GZ8MTXP02H5AHY.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgagggaaggggccctgggagtggatctcactttatttatagtagtggtacccacatactacacagactccgtgaaggccgatcacatctcagaagacaatccagaacacattgatctacaaatagaataactgagagccgagacacggccatacgtatacgtgtagtggggctagtttactacgtaccccgtgggggcccggggtaaccctggtccaccgtccgtaccccaccctccaccgaaccggg

SEQ ID NO: 418617 - DNA, 597 bp, Homo sapiens
  misc_feature: GZ8MTXP02HVZF7.21.78.H01.1.454.CMB.2.raw
  modified_base (355)..(355): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaggcctggagtggatctcactttattatagtggtgtaccccanatactacacagactccgtgaaacggggccgacttcaccatcctcaagaaacgacaattcccaaggaaacacattgtatcttacaaatgaaataactgagagccgagacacggcatgtatacgtgtggtggggtactagtttacgttacgtaccccgggttcgggggacccggggtaaccgtcgggttacccgtacccggttcccctaccccctacccccgttacccaaccccggaacccggg

SEQ ID NO: 418618 - DNA, 548 bp, Homo sapiens
  misc_feature: GZ8MTXP02JM08R.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccccacatactacacagactccgtgaagggccgattcaccatctcagaagacaattccaggaacacattgtatcttcaaatgaaataacctgagagaccgaggacacggccatgtatactgtgtggggcatttacttcgaccccgtggggcccggggaaccctggtccaccggtcctccccaccctccaccgaaccggg

SEQ ID NO: 418619 - DNA, 589 bp, Homo sapiens
  misc_feature: GZ8MTXP02JT5G8.21.78.H01.1.454.CMB.2.raw
  modified_base (298)..(298): a, c, t, g, unknown or other
  modified_base (360)..(360): a, c, t, g, unknown or other
  modified_base (397)..(397): a, c, t, g, unknown or other
  modified_base (402)..(402): a, c, t, g, unknown or other
  modified_base (440)..(440): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttcctgttagctatttcaaaaggtgtccagtgtgaggtgcagttggtggagactggaggaggcttgatccagcctggggggtccctgagactctcctgtgcagtctctgggttcgtcagtggcgactacatgagctggggtccnccagggctccaggggagggcctggagtggatctcactttatttatagtggtggtacccccanatactacacagactcgtagaacggcctatcacatcanagaanacaactcaagaactactattgtatacttaacaaagtanaataactagagacgacgacgacgacgacatagtatacgtgtcggtagggtcgtacgttacgttacgtacccggtaccggggtacccggggtacccggtccggtaccgtacccgtacccgtaccccgtacccctacccgacccgaaccgg

SEQ ID NO: 418620 - DNA, 545 bp, Homo sapiens
  misc_feature: GZ8MTXP02HDY4X.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaaggcctggagtggatctcacttatttatagtggtgtacccacatactacacagactccgtgaagggccgattcacatctacagaagacaattccaagaacacattgtatcttacaaatgaaatacctgagagaccgagacacggcatgtatactgtgtggggctatttacgtcgacccgtcggggcccgggtaaccgtggtccaccgtccaccccaccctccaccgacccgg

SEQ ID NO: 418621 - DNA, 547 bp, Homo sapiens
  misc_feature: GZ8MTXP02HSKDV.21.78.H01.1.454.CMB.2.raw
  modified_base (357)..(357): a, c, t, g, unknown or other
  modified_base (459)..(459): a, c, t, g, unknown or other
  modified_base (531)..(531): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggcctccgaggggaagggcctggagtggatctcactttattatagtggtgtacccanatactacacagactccgtagaaagggccgattcaccatcctcaagaagacaaattcccaaggaaacacatttagtattcttacaaaattgaaataacctganagccgagacacggcatgtatactgtgtgggcatttacgtcgacccgtggggacccggacctggccacgtccncccacctccacaacgg

SEQ ID NO: 418622 - DNA, 557 bp, Homo sapiens
  misc_feature: GZ8MTXP02I1MG3.21.78.H01.1.454.CMB.2.raw
  modified_base (402)..(402): a, c, t, g, unknown or other
  modified_base (483)..(483): a, c, t, g, unknown or other
  modified_base (534)..(534): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccaggggaagggcctggagtgggatctctactttatttatagtggtggtaccccacatactacacagactccgtgaagggccattcacatctcagaanacaatccaagaacacattagtatacttacaaatgaaataacctagagagaccgagacacggccatgtatactgtggtgggntatttacgtcgacccgtgggggacccggtaaccgtggtcccacccgttccncccccaccctccaaccgaaccgg

SEQ ID NO: 418623 - DNA, 607 bp, Homo sapiens
  misc_feature: GZ8MTXP02IVFUW.21.78.H01.1.454.CMB.2.raw
  modified_base (493)..(493): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcgtgggtttcctgttgctatttcaaaaggtgtccagtgtgaggtgcagttggtggagactggaggaggcttgatccagcctggggggtccctgagactctcctgtgcagtctctggggttcgtcagtggcgactacatgagcgtggggtcccgccagggctccgaggggaggcctggagtggatctcactttatttatagtggtggtaccccacatactacacagactccgtgaaaggggccattcaccatctcagaagacaattcccaaggaacacattagtatcttacaaaatgtaaactaaaccgtgaacgagacccgaaggacaacggccaagtgtaattacgnggttaggtggggactacgtttacgtcgtacccccgttgggggacccgggtaacccgtgggtacccgaacccggttcccacccccgtaccccttaccgaaccccgtaacccgggg

SEQ ID NO: 418624 - DNA, 542 bp, Homo sapiens
  misc_feature: GZ8MTXP02G0YTA.21.78.H01.1.454.CMB.2.raw
  modified_base (296)..(296): a, c, t, g, unknown or other
  modified_base (439)..(439): a, c, t, g, unknown or other
  modified_base (462)..(462): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccnccaggctccgaggggaaggcctggagtggatctcacttatttatagtggtggtaccccacatactacacagactccgtgaagggccgattcacatctcagaagacaatccagaacacattgtatctacaaatgaataactganagccgagacacggcatgtatacngtgtggggctatttactcgaccccgtgggggacccgggaaccgtggtccaccggtcctccccgaccctccaccaaccggg

SEQ ID NO: 418625 - DNA, 566 bp, Homo sapiens
  misc_feature: GZ8MTXP02H0YTK.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtccgccaggctccgaggggaaggggccctgggagtgggatctctactttatttatagtggtggtaccccacatactacacagactccgtgaaagggcccgattccaccatctcagaagacaattcccaaggtaacacattgtaatctacaaatgaataacctgagagccgagacacggccatgtattactgtgtgggctatttactacgtaccccgtgggggacccggaaccgtggtccacccggtcctacccccacctacccaccgaaccggg

SEQ ID NO: 418626 - DNA, 551 bp, Homo sapiens
  misc_feature: GZ8MTXP02F7JJM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaaggcctggagtggatctcactttatttatagtggtggtaccccacatactacacagactccgtgaagggccgattcacatctcagaagacaattcagaacacattgtatactcaaaatgaaataacctgagagaccgagacacggccatgtattactgtgtggggctatttacttcgaccccgtcgggggcccgggaacctcggtccaccgtcctcccccgaccctccgaccgaaccggg

SEQ ID NO: 418627 - DNA, 562 bp, Homo sapiens
  misc_feature: GZ8MTXP02JOI0J.21.78.H01.1.454.CMB.2.raw
  modified_base (476)..(476): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtgggatctcacttatttatagtggtggtaccccacatactacacagactccgtgaagggccgattcacatctacagaagacaattccaaggaacaccattgtatcttacaaatgaaataacctgagagccgaaggacacggcatgtattacgngtcggtggggtctatttacgttcggaccccgtcgggggacccggggtaacctggtccacggtcctaccccaccctccaaccgacgg

SEQ ID NO: 418628 - DNA, 551 bp, Homo sapiens
  misc_feature: GZ8MTXP02JIMUU.21.78.H01.1.454.CMB.2.raw
  modified_base (469)..(469): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaggcctggagtggatctcacttatttatagtggtggtaccccacatactacacagactccgtgaaacgggccgattcaccatctacagaagacaattccagaacacattgtatcttacaaatgaaataacctgagagccgagacacggcatgtattacngtgtggggctatttacgtgaccccgtgggggcccgggtaaccctggtccaccggtccctacccaccctccaccgtaaccggg

SEQ ID NO: 418629 - DNA, 575 bp, Homo sapiens
  misc_feature: GZ8MTXP02IH0XT.21.78.H01.1.454.CMB.2.raw
  modified_base (402)..(402): a, c, t, g, unknown or other
  modified_base (422)..(422): a, c, t, g, unknown or other
  modified_base (451)..(451): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctggggtcccgccaggctccaggggaagggccctggagtggatctcacttatttatagtggtggtaccccacatactacacagactccgtgaaggggccgattccacatctacanaagacaattcccaagaaacncaattgatcttcaaatgaaataacctganagccgagacacggcatgtattaacgtgtgtggggctattttaacgttcgacccccgtgggggacccgggaacccgtggggtacccaccggttccctaccccgaccccttccaccgaaacccggg

SEQ ID NO: 418630 - DNA, 573 bp, Homo sapiens
  misc_feature: GZ8MTXP02GCYJQ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgaggggaaggcctggagtggatctcactttatttatagtggtcggtaccccacatactacacagactccgtgaaacgggccattccacatctcagaaagacaattccaagaaacactaattgtatcttacgaaaatgaaataacctgagagaccgaggacacggtccatgtattacgtgtcggtggggactatttacgtcgaccccgtacgggggcccggggaaccctggtccaccggtccctccccaccctacccaccgaacccgg

SEQ ID NO: 418631 - DNA, 567 bp, Homo sapiens
  misc_feature: GZ8MTXP02HKWUX.21.78.H01.1.454.CMB.2.raw
  modified_base (366)..(366): a, c, t, g, unknown or other
  modified_base (419)..(419): a, c, t, g, unknown or other
  modified_base (476)..(476): a, c, t, g, unknown or other
  modified_base (481)..(481): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtccgccgaggctccgaggggaaggcctggagtggatctcactttattatagtggtgtaccccacatactacanagactccgtgaaagggccattccaccatctacagaagacaattccagaaacanattgatcttacaaagtgaaataacctagagagccgaaggacacggccatgtattacnggtgnggggctagtttacttacgacccccgtgggggacccgggtaaccctgggtcacccggtccctaccccaccccgtcaacccgaaccgg

SEQ ID NO: 418632 - DNA, 562 bp, Homo sapiens
  misc_feature: GZ8MTXP02I1GVM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtcccgccaggcctccgaggggaagggcctgggagtgggatctcactttatttatagtggtggtaccccacatactacacagactccgtgaacgggccgattcaccatctcagaagacaattccagaacacattgtatcttacaaaatgaaataacctgagagaccgaggacacggcatgtatacgtgtgtggggctagtttactcgacccgtcgggggacccgggaaccgtggtccacccgtcctccccaccctccaccgaacccgg

SEQ ID NO: 418633 - DNA, 595 bp, Homo sapiens
  misc_feature: GZ8MTXP02JQBRM.21.78.H01.1.454.CMB.2.raw
  modified_base (483)..(483): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtggatctcacttatttatagtggtggtaccccacatactacacagactccgtgaagggccgattcaccatcacagaaagacaattcccaaggaacacattgtatcttacaaaatgaaataacctgagaggaccgaaggacacggccagtagtattacgnggttggtcgggggctaacgtttacgttcggacccccgttcggggggacccggtaacccgtgggtacccaacccggttcccacccccgacccctcccgaaccgaaacccgggg

SEQ ID NO: 418634 - DNA, 545 bp, Homo sapiens
  misc_feature: GZ8MTXP02GSJAU.21.78.H01.1.454.CMB.2.raw
  modified_base (354)..(354): a, c, t, g, unknown or other
  modified_base (478)..(478): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttagctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaaggcctggagtggatctcacttattatagtggtgtaccccanatactacacagactccgtgaaagggccgattcaccatctcagaagacaaattccaagaacacattagtatctacaaatgaaataactgagagccgaagacacggcatgtatactgtagtggggntactttactacgaccccgtggggacccgggaacctggtccaccgtctccccaccctccaccaaccgg

SEQ ID NO: 418635 - DNA, 560 bp, Homo sapiens
  misc_feature: GZ8MTXP02IORLA.21.78.H01.1.454.CMB.2.raw
  modified_base (492)..(492): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccgccaggctccgaggggaaggcctggagtggatctcacttattatagtggtgtacccacatactacacagactccgtagaaacgggcccgtattccaaccatcctcaagaaagactaaattcccaaggaacactattagtatctacaaaatgaaataacctagagagacccgagacgacgcaatgtatactgtgngggctatttacgtcgacccgtggggccggaccgtggccaccgtcctccccaccctccaaccgaaccgg

SEQ ID NO: 418636 - DNA, 562 bp, Homo sapiens
  misc_feature: GZ8MTXP02JGU6Z.21.78.H01.1.454.CMB.2.raw
  modified_base (440)..(440): a, c, t, g, unknown or other
  modified_base (485)..(485): a, c, t, g, unknown or other
  modified_base (541)..(541): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaacgggcctggagtggatcgtctactttatttatagtggtggtaccccacatactacacagactccgtgaacgggccgattcacatctacagaagacaattcccaaggaaacactattgtatacttanaaatgaaataacctgagagaccgaggacacggccatgtattacgngtggtgggctatttacgtcgacccgtcgggggaccggaaccgtggtccaccgtccnccccacctccaccgtaaccgg

SEQ ID NO: 418637 - DNA, 583 bp, Homo sapiens
  misc_feature: GZ8MTXP02GLVVU.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtggatctcactttatttatagtggtggtaccccacatactacacagactccgtgaaggccgattccacatctacagaaagacaattccaagaacacgtattagtatcttacaaatagaaataaccgtgagagaccgaggaatacggaccatgtaattacgtgtcggtggggctagtttactcggtaccccgtcgggggacccggggaaccgtggtccctacccgtccctcccccaaccctcccgaacccgtaacccggg

SEQ ID NO: 418638 - DNA, 611 bp, Homo sapiens
  misc_feature: GZ8MTXP02GUZDF.21.78.H01.1.454.CMB.2.raw
  modified_base (439)..(439): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagcgtgggtccgccaggctccgaggggaaggcctggagtggatctcactttattatagtggtggtacccacatactacacagactccgtgaagggccgataaccatctacaagaaagacaattccaaggaaacactattgtaatccttaaanaaatagtaaactaacgtagagacgaccggagaccgacggactagtagttattacgtggtggtacgggtacttaacgtttaccgtccggaccccgggtcgggggaccccgggtaaccgtcggtaacccgtacccgtccctacccccacccgtacccgaacccgaaccggtccc

SEQ ID NO: 418639 - DNA, 565 bp, Homo sapiens
  misc_feature: GZ8MTXP02JS8G0.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccaggctcgaggggaaggcctggagtggatcgtctacttatttatagtggtggtaccccacatactacacagactccgtgaacgggccgattcacatctcagaagacatccaagaacacattgtatcttacaaatgaaataacctgagacgacgagacgacggcagtagtattacgtggtggtagggctatttacgtcggaccccgtgggggacccggaaccgtcggtccacccggtcctacccccaccctcccgaaccgaacccggg

SEQ ID NO: 418640 - DNA, 607 bp, Homo sapiens
  misc_feature: GZ8MTXP02GEWVN.21.78.H01.1.454.CMB.2.raw
  modified_base (357)..(357): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggaaggcctggagtggatctcactttattatagtggtggtaccccanatactacacagactccgtgaaacgggccgattcaccatctacagaagacaaattcccaagaaacacaattgtaatcttacaaaatgaaataacctgagagccgaaggacacggaccatcgtaattacgtgtggtggggacttacgtttacgtcggtaccccgttcgggggacccccggggtaaaccgtcgggtacccgtacccggttccctaccccccgtacccgtaccccgaacccgtaaaccccgggg

SEQ ID NO: 418641 - DNA, 584 bp, Homo sapiens
  misc_feature: GZ8MTXP02IE4FS.21.78.H01.1.454.CMB.2.raw
  modified_base (355)..(355): a, c, t, g, unknown or other
  modified_base (407)..(407): a, c, t, g, unknown or other
  modified_base (423)..(423): a, c, t, g, unknown or other
  modified_base (437)..(437): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtaggctattcaaaggtgtcagtgtgaggtgcagttggtggagactggaggaggcttgatccagccgtgggggtcctgagactctcctgtgcagtctctgggttcgtcagtggcgactacatgagcgtcggggtccgccgaggcctccgaggggaagggcctggagtggatctctattattatagtggtgtaccccanattacacacagactccggtgaaaggggccctaattccaccatcctacagaanacaattaccagaacanattagtatcttaanaaatataaactaacgtgagacgacgacggacacggctatgtatacgtgtggtagggtacttacgtttacgtacggtacccggtcgggggtacccggtaccgttcggtaccgtaccgtccctaccccgtacccgtaccaaccgaccgg

SEQ ID NO: 418642 - DNA, 613 bp, Homo sapiens
  misc_feature: GZ8MTXP02HXJ49.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtcccgccgaggctccgaggggaagggcctgggagtggatctctactttatttagtaggtggtcggtacccacatactaacacacgactccggtaggaacgggccagttccacatctacaagaacgacaattccgaaggaaacactaatttagtattacttaacaaaattgaaattaaccgtagagacgaccgagacacggcatagtatacgtgtacggtgggtactacgtttacgttcgaccccggtcgggggacccggggtaacccgtggtccaaccccgtcccgtaccccctacccgtccgaacccgaacccggg

SEQ ID NO: 418643 - DNA, 547 bp, Homo sapiens
  misc_feature: GZ8MTXP02G6HAJ.21.78.H01.1.454.CMB.2.raw
  modified_base (396)..(396): a, c, t, g, unknown or other
  modified_base (463)..(463): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtccgccaggctccgaggggaaggcctggagtggatctcactttatttatagtggtggtaccccacatactacacagactccgtgaaggccgatcacatctcanaagacaatccaagaacacattgtatctacaaaatgaaataactgagagcgagacacgcatgtatacngtgtgggctagtttactcgaccccgtcggggacccgggaaccctggtccacccgtcctacccccaccctcccaccgaacccggg

SEQ ID NO: 418644 - DNA, 575 bp, Homo sapiens
  misc_feature: GZ8MTXP02JBDC7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtgggatctcacttatttatagtggtggtaccccacatactacacagactccgtgaaacgggccgattcaccatctacagaagacattccagaacacattgtatcttacaaatgaaatacctgagagaccgaggacacggccatgtattacgtgtggtggggactactttacgttcgaccccgttcgggggacccggggaacccgtggtcccgtaccggtccctaccccgacccctacccaaccgaacccggg

SEQ ID NO: 418645 - DNA, 577 bp, Homo sapiens
  misc_feature: GZ8MTXP02H42QG.21.78.H01.1.454.CMB.2.raw
  modified_base (408)..(408): a, c, t, g, unknown or other
  modified_base (415)..(415): a, c, t, g, unknown or other
  modified_base (448)..(448): a, c, t, g, unknown or other
  modified_base (492)..(492): a, c, t, g, unknown or other
  modified_base (497)..(497): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtcctgagactctcctgtgcagtctcgtgggttcgtcgagtggcgactacagtgagcgtcgggtccgccgaggcctccgaggggaacggccgtggaggtggatcgtactattatttagtaggtggtgtaccccatatactacacagactccgaggaacggcctattcaccatcncaagaanactaatccgaagaacactattagacttcttaanaaaatgaaactacgtagagacgaccgaagacacgcatgtatcgngtggnggtacttaagttccgtacgaccccggtcgggggacccggtacctggtccacccgtccacccccaccctccaaccgaccgg

SEQ ID NO: 418646 - DNA, 556 bp, Homo sapiens
  misc_feature: GZ8MTXP02H5MMS.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctaggttttccttgttgctatttcaaaaggtgtccagtgtgaggtgcagttggtggagactggaggaggcttgatccagctgggggtccctgagactctcctgtgcagtctctgggttcgtcagtggcgactacatgagctgggtccgccaggctccgaggggaagggcctggagtggatctcacttatttatagtggtggtacccacatacacacagactccgtgaagggccgattcacatctcagaagacaattccaagaacacattgatcttacaaatagaataactgagagaccgagacacggcatgtatactgtgtggggactactttacgtcgtaccccgtgggggtacccgggaacccgtggtccacccgtcccgtccccaccccgtcccaaccgaacccggg

SEQ ID NO: 418647 - DNA, 575 bp, Homo sapiens
  misc_feature: GZ8MTXP02FRA0R.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtccgccaggctccgaggggaaggcctggagtggatctcactttatttatagtggtggtaccccacatactacacagactccgtagaacggggccgattccaaccatctacagaaagacaaattcccaaggtaaacacgattagtatacttacaaaatgaaataacctgagagaccgaaggacacggcatgtaatactgtggtggggactagtttactcgtaccccgtcgggggaccggtaaccctggtaccaccgtcctccccaccctcccaccgtaaccgg

SEQ ID NO: 418648 - DNA, 557 bp, Homo sapiens
  misc_feature: GZ8MTXP02JVXUJ.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccagggctccgaggggaagggcctggagtggatctcacttatttatagtggtggtaccccacatactacacagactccgtgaagggccgattcaccatctcagaagacaattccaaggaacacattgtatcttacaaatgaaataacctgagaggaccgagacacggccatgtattacgtgtgtggggctagtttactcgaccccgtgggggacccggaccctggccaccgtcctacccccacctcccgaccgaaccggg

SEQ ID NO: 418649 - DNA, 566 bp, Homo sapiens
  misc_feature: GZ8MTXP02GTA0T.21.78.H01.1.454.CMB.2.raw
  modified_base (348)..(348): a, c, t, g, unknown or other
  modified_base (488)..(488): a, c, t, g, unknown or other
  modified_base (497)..(497): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccagggctccgaggggaacggggcctggagtggatctctactttatttanagtggtggtaccccacatactacacagactccgtgaaacggccgattcaacatctacagaaagacaaattccaagaaacactattgtatactacaaaatgaaataacctgagagccgaaggacacggacatgtattacgngtggtgggntaacgttacgtcgacccgtcgggggcccgggaacctggtccaccgtcctccccacctccaccgaaccgg

SEQ ID NO: 418650 - DNA, 543 bp, Homo sapiens
  misc_feature: GZ8MTXP02IZZMB.21.78.H01.1.454.CMB.2.raw
  modified_base (354)..(354): a, c, t, g, unknown or other
  modified_base (396)..(396): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggagggcctggagtggatctcacttattatagtggtggtaccccanatactacacagactccgtgaagggccgatcacatctcagaanacaattccagaaacacattgtatacttacaaaatgaaataactgagagacgagacacggcatgtatactgtgtgggctagtttactcgaccccgtggggacccgggaacctggtccaccgtcctaccccaccctccaccgaaccggg

SEQ ID NO: 418651 - DNA, 630 bp, Homo sapiens
  misc_feature: GZ8MTXP02G9GPR.21.78.H01.1.454.CMB.2.raw
  modified_base (271)..(271): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtaggctattacaaaggtgtcagtgtgaggtgcagttggtggagactggaggaggcttgatccagccgtggggggtccctgagactctcctgtgcagtctcgtgggttcgtcgnggtcggcgactacagtgacgcggtcgggtccgccgacggccgtacggaggggacggcgtaggagtggactctactattattagtggtggtacgaccatatacacacacgactcgagacggcctatcactatcacgaagaaagactaactacgaacgaactactattacgtactactaactaaatacgtaaactaacgtagacgacggacgaacgaaccgtacgactagttagttacgttacgtggtacggtacggtacttacgtttaccgttaccggtacccggtacgggggtacccgggtaaccgtccggtaccgtacccgtcccctacccccgtacccgtacccgaaccggtaccgg

SEQ ID NO: 418652 - DNA, 622 bp, Homo sapiens
  misc_feature: GZ8MTXP02IBNNI.21.78.H01.1.454.CMB.2.raw
  modified_base (371)..(371): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctcctgtgcagtctcgttgggttcgtcaggtggcgactacatgagcgtcggggtcccgccgagggcctccgaggggaacggccgtgggagtgggatctctacttattagtagtggtagtaccccanatactacacagactccgtagaacggcctattaccaccatcctacaagaaagactaacttacccgaaggaaacactagtttagtacttctaacaaattagaaactaaacgtgaagacggaccgaaggaccacggcaagttagtacttaacgtgtaggtcggggtctacgttttacgtcggaaccccgttgggggacccgggtaaccgtggttccacccggttccacccccgtacccaccgaaccggaccggg

SEQ ID NO: 418653 - DNA, 589 bp, Homo sapiens
  misc_feature: GZ8MTXP02IQEOK.21.78.H01.1.454.CMB.2.raw
  modified_base (297)..(297): a, c, t, g, unknown or other
  modified_base (483)..(483): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtccnccaggctccgaggggaaggcctggagtggatctcacttatttatagtggtgtaccccacatactacacagactccgtgaagggcccgattccaccatctacagaaacgacaattccaaggaacacattgtatcttacaaaatgaaataacctgagagaccgaggacacggccaagtgtaattacgnggtggtggggactaactttacgttcggacccccgtgggggaccccgggaaacccttggtaccacccggttcccacccccgacccctacccgaaccgaaacccgggg

SEQ ID NO: 418654 - DNA, 565 bp, Homo sapiens
  misc_feature: GZ8MTXP02IQ7LR.21.78.H01.1.454.CMB.2.raw
  modified_base (478)..(478): a, c, t, g, unknown or other
  modified_base (483)..(483): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtccgccgaggctccgagggaagggccgtggagtggatctctactttattagtagtggtggtacccacatactacacagactccgtagaagggccgattcaccatctcagaagacaattccaaggaacactattagtatcttacaaatagaaataacctgagagcgagacacgcatgtattacngtggngggctactttacgtcgaccccgtcggggcccgggaaccgtcggtccgacccgtccctccccgaccctccaacccgaaccggg

SEQ ID NO: 418655 - DNA, 612 bp, Homo sapiens
  misc_feature: GZ8MTXP02JT4EH.21.78.H01.1.454.CMB.2.raw
  modified_base (298)..(298): a, c, t, g, unknown or other
  modified_base (356)..(356): a, c, t, g, unknown or other
  modified_base (491)..(491): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagctgggtccnccgaggctccgagggaaggcctggagtggatctcacttattatagtggtgtaccccanatactacacagactcgtagaagggccgattcacatctacaagaagacaacttaccgaagaaacaccattagtacttacttacaaaatacgaaataacccgtagaagacgaccgaaggacacggcatcgtattacnggttggtcggggtctacgttttaccgtacgtaccccgggtcgggggaccccgggtaacccgtggtacccgtaacccggttccctacccccgtaaccccgtcccgaacccgaaaccccgggg

SEQ ID NO: 418656 - DNA, 649 bp, Homo sapiens
  misc_feature: GZ8MTXP02GFRP9.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccggagggaagggccgtggagtggatctacgtactttatttataggtggtacggtaaccccacgacttactacaacacgtactcccgggtaggaaacggggaccgtattaccaacctagtcctacaagaaacgaactaaacttaccgaaggaaacactatttagtatacttaacaaatagaaataaccgtagaacgacgaccgaggaccacggctagtcgtatacgtggtaggtgggcttacgtttacgtaccggtacccggttcgggggacccggggtaacccgtcggtacccgaaccccggttccctacccccaccccttacccgaacccgtaacccggg

SEQ ID NO: 418657 - DNA, 591 bp, Homo sapiens
  misc_feature: GZ8MTXP02JAT6T.21.78.H01.1.454.CMB.2.raw
  modified_base (493)..(493): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatctcacttatttatagtggtggtaccccacatactacacagactccgtgaaagggccgattcaccatctacagaaagacaaattcccaaggaaacactattagtaattacttcaaaatgaaataacctgagagaccgagacacggccaagtgtattactgttacggngggggtacactttacgttcggaacccccgttgggggaccccggggtaaccctgggtccgaacccgtccttcccccaaccctccgaacccaaaccgggg

SEQ ID NO: 418658 - DNA, 567 bp, Homo sapiens
  misc_feature: GZ8MTXP02HCAGT.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccgaggctccgaggggaagggcctggagtggatctcacttatttatagtggtcggtacccacatactacacagactccgtgaaggccattcacatcacagaagacaattccaaggaacacattgtatctacaaaatgaaatactgagagaccgaggacacggacatgtatacgtggtcgtgggctacgtttacgtaccgacccggttcgggggcccggtaaccgtggtaccaccggtccctaccccgacccctccgaacccgaaccggg

SEQ ID NO: 418659 - DNA, 588 bp, Homo sapiens
  misc_feature: GZ8MTXP02G3K7D.21.78.H01.1.454.CMB.2.raw
  modified_base (299)..(299): a, c, t, g, unknown or other
  modified_base (359)..(359): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctggggtccnccaggctccgaggggaagggcctggagtggatctcactttattatagtggtgtaccccanatactacacagactccgtgaaagggccgattcaccatctacagaagacaattacaagaacacgattgtatacttacaaatgaaataaccttgagacgacgagacacggccatgtattacgtgtcggtggggctactttaacgttccgacccgtcgggggacccggggtaacccgtggtacccgtacccgtcccgtacccccaccccgttacccgaacccgaacccgggg

SEQ ID NO: 418660 - DNA, 551 bp, Homo sapiens
  misc_feature: GZ8MTXP02HOOTT.21.78.H01.1.454.CMB.2.raw
tcagtcgtcgctcgcacgaccggtgctcgattagtgtgagtagtttgggtttgggggagaggagcccagcactgggattccgaggtgtttccattcggtgatcagcactgaacacagaggactcaccatggagttttggctgagctcggttttccttgttgctattttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcactttattatagtggtggtaccccacatactacacagactccgtgaaggccgattcacatctcagaagacaattcccaaggaacacattgtatacttacaaaatgaaactaaccgtgagacgaccgaaggacacggccagtgtatacgtgtgtggggctatttactcgacccgtggggacccggacctgggccaccgtccaccccaccctccaccgaccgg

SEQ ID NO: 418661 - DNA, 579 bp, Homo sapiens
  misc_feature: GZ8MTXP02GKGD0.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggcctccgaggggaaggcctggagtggatctcactttatttatagtggtggtacccacatactacacagactccgtgaacgggccgattccacatctacagaagacaattccaaggaacacattgtatctacaaatagaaataacctagagacgaccgagacgacggccatgtattactggtggtggggctacgtttacgttacgtaccccgtcgggggcccggggaacccgtcgggtcccacccgtccctcccccaccctcccaacccgaacccggg

SEQ ID NO: 418662 - DNA, 577 bp, Homo sapiens
  misc_feature: GZ8MTXP02HP8ZC.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggcctccgaggggaaggggcctggagtggatctcactttatttatagtggtggtaccccacatactacacagactccgtgaagggccgattccaccatctcagaagacaattccaagaacacattgtatcttacaaatgaaataacctagaagagaccgagacacggcatagtatacgtgtgtggggactacgtttacgttacgtaccccgtcgggggacccggggaacccgtggtccacccggttcctacccccgacccctccaacccgaacccggg

SEQ ID NO: 418663 - DNA, 560 bp, Homo sapiens
  misc_feature: GZ8MTXP02IFA7V.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccaggctccgagggaagggcctggagtgggatctcacttatttatagtggtggtaccccacatactacacagactccgtgaaagggccgattccaccatctacagaagacaaattcccaaggaacacattgtatcttacaaatgaaataacctgagagccgagacaggccatgtattacgtgtgtggggcatttactgaccccgtgggggcccggaaccgtggtacccaccggtcctcccccgaccctccaaccgtaaccggg

SEQ ID NO: 418664 - DNA, 609 bp, Homo sapiens
  misc_feature: GZ8MTXP02GRBQB.21.78.H01.1.454.CMB.2.raw
  modified_base (369)..(369): a, c, t, g, unknown or other
  modified_base (473)..(473): a, c, t, g, unknown or other
tcagtcgtcgctcgcacgaccggtgctcgattagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtggggtcccgccgaggcctccgaggggaacgggcctgggagtggatctctactttatttataggtggtggtaccccanatactacacacgactccgtagaaacggggccgtattccaccatctacagaaacgacaaacttcccaaggaacactattgtaatcttacaaatgaaatacctganacgacgagacgacggacatcgtattacgtggtggtgggtactacgtttacgtacggtaccccgtcgggggaccccggggtaaccctcgggtacccaccggttccctacccccgaccctacccgacccgaacccggg

SEQ ID NO: 418665 - DNA, 574 bp, Homo sapiens
  misc_feature: GZ8MTXP02GJIAD.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctattttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtgggatctcactttatttatagtggtggtacccacatactacacagactccgtgaagggccgattccaccatctcagaagacaatccaaggaacacattgtatcttacaaatgaaataacctgagaagccgagacacggccatgtattactgtgtggggctagtttactcggaaccccgtgggggcccggggtaaaccctgggtcccgaccgtaccgttacccccacccctccaacccgaaacccgggg

SEQ ID NO: 418666 - DNA, 574 bp, Homo sapiens
  misc_feature: GZ8MTXP02J0WFW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgagggaaggggcctggagtggatctcactttatttatagtggtggtaccccacatactacacagactccgtgaaacgggccatcaccatctcagaagacaattccaagacacattgatctacaaatgaatactgagagccgagacacggcatgtatacgtgtagtgggctagtttacgttcgacccccgtgggggtaccccggggtaacccgtcggggtcctaaccccgtcccgtaccccccacccgttaccccgaaccgaacccgggg

SEQ ID NO: 418667 - DNA, 649 bp, Homo sapiens
  misc_feature: GZ8MTXP02GRUXB.21.78.H01.1.454.CMB.2.raw
  modified_base (358)..(358): a, c, t, g, unknown or other
tcagtcgtcgctcgcacgaccggtgctcgatttagtgtgagtagtttgggtttggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggcctcgagggacgtcgtggagtggatctctactttatttataggtggtcgtacccanatactacacagactccgtagaacggggcctattccactactctacaagaaacgacaacttaccgaaggaaccagtatttgtaattctaacaaaatgaaaactacgtagaagacggacccgaaggaccaacgggctaagttgttaacttacgtggttagggtcggggtacttaacgtttttaaccgcggtacccccggggtacggggggaccccgggtaaacccttcgggtaccccgtaacccggttcccctaccccccggtacccctaccccgaaaccggtaaccccgggg

SEQ ID NO: 418668 - DNA, 600 bp, Homo sapiens
  misc_feature: GZ8MTXP02INZ0H.21.78.H01.1.454.CMB.2.raw
  modified_base (267)..(267): a, c, t, g, unknown or other
  modified_base (279)..(279): a, c, t, g, unknown or other
  modified_base (281)..(281): a, c, t, g, unknown or other
  modified_base (320)..(320): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtaggctattacaaaaggtgtccagtgtgaggtgcagttggtggagactgggaggaggcttgatccagccgtggggggtccctgagctctctgtgcagtctctgggttcnagtggcgactanangagcgtcggtccgccgacggcgtcgagggacggcgtggnggtgtatctctattattagtagtggtacgtaccactactactacacacgacgtcgtacggacggacgtactaccactactactacagaacgaactaactacgaacgaacactattagtatactactaaatagtaactaacgtagagacgacgacgacgacgacgtagtagtagtagtgtcggtaggtacgtacgttacgttacgtacccggtaccggggtaccgggtaccggtaaccggtaccgtacccgtcccgtaccccgtaccctaccgaccgaccg

SEQ ID NO: 418669 - DNA, 583 bp, Homo sapiens
  misc_feature: GZ8MTXP02FWZ8U.21.78.H01.1.454.CMB.2.raw
  modified_base (347)..(347): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaaggggcctgggagtgggatcgtcactttatttanagtggtggtaccccacatactacacagactccgtgaagggccgattcaccatctacagaagacaaattcccaaggaacacattgtatacttacaaaatgaaataacctgagacgacgagacacggccatgtatactgtgtggggactagtttactcggaccccgttcgggggacccggggtaacccgtcggtccgaaccggttccctcccccgaccctcccgaaccgaaacccggg

SEQ ID NO: 418670 - DNA, 565 bp, Homo sapiens
  misc_feature: GZ8MTXP02GPLEW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctggggttcgtcagtggcgactacatgagctggggtccgccaggctccgaggggaggcctggagtggatctcactttatttatagtggtggtacccacatactacacagactccgtgaacgggccgattccaccatctacagaagacaattccaagaacactattagtatcttacaaatgaaatactgagagacgagacacggcatgtatacgtgtaggtggggctagtttacgtcggaccccgtcgggggacccggggaaccctggtccaccggtcctcccccgaccctccgacccgaacccggg

SEQ ID NO: 418671 - DNA, 570 bp, Homo sapiens
  misc_feature: GZ8MTXP02IEOWD.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctctacttatttatagtggtggtaccccacatactacacagactccgtgaagggcccgattccaccatcctacagaagacaattccaaggaacacattgtatcttacaaatagaaataacctgagagaccgaggacacggccatgtattacgtagtcggtggggctatttacttcgaccccgtgggggcccgggaaccgtcggtccaccggtcctcccccgaccctcccgaccgaacccggg

SEQ ID NO: 418672 - DNA, 577 bp, Homo sapiens
  misc_feature: GZ8MTXP02F5NSG.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtgggatcgtcactttatttatagtggtggtaccccacatactacacagactccgtgaagggccgattccacatctcagaagacaattcccaaggaacacattagtatacttacaaatgaaataacctgaagacgaccgaggacacggcatgtattacgtgtcggtggggctagtttacgtcgaccccggtcgggggacccgggtaaccctgggtccctaccgtccctacccccacccgtccaaccgtaaccggg

SEQ ID NO: 418673 - DNA, 564 bp, Homo sapiens
  misc_feature: GZ8MTXP02JWCGS.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtggatctcactttatttatagtggtggtaccccacatactacacagactccgtgaaagggccgattccaccatctcagaagacaattccaaggacacattgtatcttacaaatgaaataacctgagagaccgaggacacggccatgtattacgtgtgtggggctacgtttactcgaccccgtcgggggcccggggtaacccgtggtccaccggtcctcccccgaccctcccaccgaaccgg

SEQ ID NO: 418674 - DNA, 587 bp, Homo sapiens
  misc_feature: GZ8MTXP02JDCI9.21.78.H01.1.454.CMB.2.raw
  modified_base (410)..(410): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtcggggtccgccgaggcctccgaggggaacggggcctgggagtgggatctcacgtttattagtagtggtggtaccccacatactacacacgactccggtgaacggccgattcacatcnagaagacaatcccaagaacactatgtaatacttacaaaatgaaataacctgaagacggaccgaaggaccaccggacatgtatacgtgtcgtgggctagtttacgtcgacccggtcggggacccgggtaaccgtcggtccacccgttccgtacccccaccctacccaaccgtaaccgg

SEQ ID NO: 418675 - DNA, 597 bp, Homo sapiens
  misc_feature: GZ8MTXP02G6Q0C.21.78.H01.1.454.CMB.2.raw
  modified_base (357)..(357): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggagggcctggagtggatctctacttatttatagtggtggtaccccanatactacacagactccgtgaaggccgattccacatctcagaagacaatccaagaacacattgtatcttacaaatagaaataacctgagagacgagacgacggacatagtactacgtgtaggtcgggactagtttacgttacgacccccggttacgggggaccccggggtaaacccgtcgggtacccgtacccggttaccccgacccccgtaccccttccccgtaacccgaaaccccgggg

SEQ ID NO: 418676 - DNA, 576 bp, Homo sapiens
  misc_feature: GZ8MTXP02HOXLC.21.78.H01.1.454.CMB.2.raw
  modified_base (300)..(300): a, c, t, g, unknown or other
  modified_base (370)..(370): a, c, t, g, unknown or other
  modified_base (379)..(379): a, c, t, g, unknown or other
  modified_base (411)..(411): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttctcagtggcgactacatgagcgtgggtcccnccgaggctccgaaggggaacggcctgggagtgggatcgttcactttatttataggtggtaggtaccccanatactacanagactccgtgaaacgggccgattccaccatcncagagacaattccaagacacattgatctacaaatagaaataacctgacagaccgagacgacggccatcgtatacgtgtaggtgggctactttcgacgtacccgtcgggggacccgggaacctgggcctacccggttcccaccccgacccctccgaacgacccggg

SEQ ID NO: 418677 - DNA, 577 bp, Homo sapiens
  misc_feature: GZ8MTXP02J2Y41.21.78.H01.1.454.CMB.2.raw
  modified_base (299)..(299): a, c, t, g, unknown or other
  modified_base (403)..(403): a, c, t, g, unknown or other
tcagtcgtcgctcgcacgaccggtgctcgatttagtgtgagtagtttgggtttgggggggagaggtgcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccaggcctccgagggaggcctggagtggatctctacttatttatagtggtggtaccccacatactacacagactccgtgaaacgggccattcacatcacagaanacaattccagacacattgtatctacaaatagaataactgagacgaccgagaccacggcctatggtattacgtggtcgtggggactacgtttacttcgggaccccgttcgggggacccggggaaccctggggtaccacccgtccctacccccgcccgtacccgaccgaacccggg

SEQ ID NO: 418678 - DNA, 595 bp, Homo sapiens
  misc_feature: GZ8MTXP02FTPYK.21.78.H01.1.454.CMB.2.raw
  modified_base (442)..(442): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtcccgccgaggcctccgaggggaacgggccgtggagtggatctcactttatttatagtggtggtaccccacatactacacagactccgtagaacgggcctatccacatctacaagaagacaattccgaagaacacattgtatactanaaatgaaataccgtgagacgcgaagacacggccagtgtattacgtgtggtggggctacgtttacgttcggaccccgtgggggaccccgggtaaacccgtcgggtacccacccggttccctacccccgacccctcccgaacccgtaaacccggg

SEQ ID NO: 418679 - DNA, 574 bp, Homo sapiens
  misc_feature: GZ8MTXP02HCWOP.21.78.H01.1.454.CMB.2.raw
  modified_base (299)..(299): a, c, t, g, unknown or other
  modified_base (361)..(361): a, c, t, g, unknown or other
  modified_base (395)..(395): a, c, t, g, unknown or other
  modified_base (398)..(398): a, c, t, g, unknown or other
  modified_base (464)..(464): a, c, t, g, unknown or other
  modified_base (474)..(474): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccnccgaggctccgaggggaacggcctgggagtggatctcacttatttatagtggtgtaccccanatactacacagactcgtgaagggccatcacatcncanaagacaatcaagaacacattgtatctactaaatgaaataactgagacgaccgagacgacgccagtntatactgtgngggtctagtttacgtcgtaccccgtcgggggacccggggtaacccgtcggtacccgtacccgtcccgtacccccgacccgtaccccacccgtaacccggg

SEQ ID NO: 418680 - DNA, 631 bp, Homo sapiens
  misc_feature: GZ8MTXP02F9G45.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccgagggcctccggaaggggaacggggccgtgggagtggatctactactttatttatagtggtgtaccccacatactacacacgactccgtagaacgggccgattccacactctacaagaaacgacaattaccaagaacactattagtatactacaaatagaaactaacctagagacgaccgaacggacgacggacagtgtaattacgtggtggtacggggacttacgtttacgttcggtaccccggtacgggggacccggggtaaacccgtcggggtaccctacccggtcccctacccccgtaccccgtacccgaacccgaaccccggg

SEQ ID NO: 418681 - DNA, 630 bp, Homo sapiens
  misc_feature: GZ8MTXP02JWYGK.21.78.H01.1.454.CMB.2.raw
  modified_base (252)..(252): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtagctattacaaaaggtgtccagtgtgaggtgcagttggtggagactggaggaggcttgatccagcctggggggtccctgagctctcctgtgcngtctcgtggttcgtcagtggcgactacatgagcgtcggtccgcgacggcgtcgagggacgggcgtggaggtggtactctctacttatttagtagtggtcgtacccactactactacacacgacgtcgtacggacggacgtactacacactactacaacgaaacgaactaactacgaacgaacaactattagtacttacttaactaaataagtaaactaactagagacgacgacgacgacgacgacgtagtagtacgtaggtcggtcgggtacgttacgttacgttaccggtacccgggtaccgggggtacccggggtacccggtaaccggtaccgtacccgtaccctaccccgtaccccgtacccgaccgtaacccgg

SEQ ID NO: 418682 - DNA, 678 bp, Homo sapiens
  misc_feature: GZ8MTXP02GV8GV.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgagggcctccgaggggaacggggccgtggaggtggatctcgtactttatttagtagtggtggtaccccacatactacacagactcgtagaacgggccattcacgatctacagaacgacaacttccaagaacacgtatttagtacttacttaacaaaatcgtaaaactaaccgtgaagacggaccgaacgggaacaccgggacctaagtcgttaagttacgtggttaggggtcgggggtacttaacggttttaccgttacccgggacccccgggttacggggggtacccccggggtaaaacccgttcggggttaaccccgtaccccgggttacccctaccccccgacccccgttaccccgaacccggtaaacccccgggg

SEQ ID NO: 418683 - DNA, 639 bp, Homo sapiens
  misc_feature: GZ8MTXP02H0ZRK.21.78.H01.1.454.CMB.2.raw
  modified_base (360)..(360): a, c, t, g, unknown or other
  modified_base (449)..(449): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtcccgcaggctccgaggggaacggccgtggagtggatctctactttattatagtggtgtacccanatactacacagactccgtagaacgggccgattccacatctacagaaacgacaattcccgaaaggaaactacatttagacttccttaaanaaatagaaacttaacgtagaacgacgaccggaagaccgacggtactagttacgttaattacgtggttacgggtacgggtacttaacgttttaccggtaccggtacccggggtacgggggaccccgggtaccgttccggtacccgtacccgttccccgtaccccctaacccgtacccgaacccggtaccgg

SEQ ID NO: 418684 - DNA, 590 bp, Homo sapiens
  misc_feature: GZ8MTXP02IGFEN.21.78.H01.1.454.CMB.2.raw
  modified_base (301)..(301): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctggggtcccnccgaggctccgaggggaaggcctggagtggatctcacttatttatagtggtggtaccccacatactacacagactccgtgaaggccgattccacatcctcagaagacaattccaaaggaacactaatttgtaattacttacaaaattgaaactaaccttgaagacgaccgaaggacacggccaagtgttaatacgtgtggtggggctatttacgtcgaccccgttgggggcccggaaacccgtggtaccacccgtccctacccccgtaccctaccaacccgaacccggg

SEQ ID NO: 418685 - DNA, 558 bp, Homo sapiens
  misc_feature: GZ8MTXP02F0YJ1.21.78.H01.1.454.CMB.2.raw
  modified_base (536)..(536): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcactttatttatagtggtggtaccccacatactacacagactccgtgaagggccattcacatctcagaagacaaattccaagaaacacattagtatcttacaaaatgaaaataacctgagagccgaaggacacggccatgtatactgtgtggggactatttactcgaccccgtaggggccggggaaccctgggtaccaccggtccncccccacctccgaccaaccggg

SEQ ID NO: 418686 - DNA, 665 bp, Homo sapiens
  misc_feature: GZ8MTXP02HAWLS.21.78.H01.1.454.CMB.2.raw
  modified_base (298)..(298): a, c, t, g, unknown or other
  modified_base (364)..(364): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccnccgaggctccgaggggaacgggcctggagtggatcgtctacttatttagtagtggtggtaccccanatactacacagactccgtagaacggggccattcacgatctacaagaaacgacaacttacccgaaggaaacactattagtattacttacaaaatgtaaactaaccgtagaacgacggaccgaacggaacgaccgggacctaagtagttaacgttaacgttggttagggtccgggggtattaacgttttaccggttaccgtacccccgggttacggggggtaccccggggtaaaacccctcggggtaccctaaccccgggtcccttaacccccaccccgttacccaaaaccggaaccccgggg

SEQ ID NO: 418687 - DNA, 611 bp, Homo sapiens
  misc_feature: GZ8MTXP02JTAWA.21.78.H01.1.454.CMB.2.raw
  modified_base (299)..(299): a, c, t, g, unknown or other
  modified_base (488)..(488): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccnccgaggcctccgaggggaggccgtaggagtggatcgtctacttattagtagtggtagtacccacatactacacagactcgtagaacggccgattcactatcacaagaagactaactccgaagaacacgtattcgattctacaaaatgaaactaccgtgaacgacgaccgagacacggcatgtattacgnggttaggcggggtactacgtttactccgggtaccccgtcgggggaccccggtaaccgtcggggtccccgtaaccccggttcccttaccccccgaccccgtaccccgaacccggaaccccgggg

SEQ ID NO: 418688 - DNA, 536 bp, Homo sapiens
  misc_feature: GZ8MTXP02HH7PT.21.78.H01.1.454.CMB.2.raw
  modified_base (355)..(355): a, c, t, g, unknown or other
  modified_base (466)..(466): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaggcctggagtggatctcgacttattatagtggtggtaccccanatactacacagactccgtgaaagggccgattcacatctcagaagacaattccaagaacacattgtatctacaaatgaaataacctgagagcgaggacacggcatgtatacngtagtgggctattacgtcgacccgtggggacccggacctggtcaccgtctccccacctccgaccaaccgg

SEQ ID NO: 418689 - DNA, 585 bp, Homo sapiens
  misc_feature: GZ8MTXP02G9QGL.21.78.H01.1.454.CMB.2.raw
  modified_base (357)..(357): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaaggcctggagtggatctcacttattatagtggtgtaccccanatactacacagactccgtgaagggccgattcaccatctcagaagacaattccagaacacattgtatacttacaaatgaaataacctgagagaccgaggacacggccagtcgtaattacgtgtggtggggactacgtttacttacggaccccgtcgggggacccggggtaacccgtcgggtacccgtacccgtccctacccccgacccctacccgaacccgaacccggg

SEQ ID NO: 418690 - DNA, 656 bp, Homo sapiens
  misc_feature: GZ8MTXP02HUNCI.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctctgggttcgtcagtggcgactacatgagcgtgggtcccgccaggcctccgaaggggaacggggcccgtgggaaggtgggacttcgtactactttatttagtaggtggtacggtaccccactactactacacacgactccggtagaacgggcctagttaccacatccacaagaagacaacttccaaaggaacactattgtatcttaacaaatgaaacttaacctagaagacgaccgaacggaacgaccggacattagtaacgttactggtaggtaggggtacttaacgtttacgttaccggtaacccccggtcgggggtaccccggggtaaacccgtcggtacccgtaacccggttccccgtacccccacccccggttacccaaacccggtaacccgggg

SEQ ID NO: 418691 - DNA, 589 bp, Homo sapiens
  misc_feature: GZ8MTXP02I7E4F.21.78.H01.1.454.CMB.2.raw
  modified_base (298)..(298): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccnccgaggctccgaggggacgggcctggagtggatctcacttatttatagtggtggtacccacatactacacagactccgtgaacgggcctatcacatctcagaaagacaattcccaagaacacattagtatcttacaaaatgaaactacctagacgacgaccgaacggaccacgggccagtgtaattacgtggtacggtaggggtctacgtttacttcggtacccccgtgggggaccccggggtaacctcgggtccacccgtccctcccccacccctccaacccgaaccggg

SEQ ID NO: 418692 - DNA, 835 bp, Homo sapiens
  misc_feature: GZ8MTXP02JSOO5.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtgggttcgtcgaggtggcgactacatggagcgtcgggtcccgccgaggcctaccggaggggaacggggcccgtagggaggtgggacttccgtacttaactttaagttttaagttaggttgggttacggtaaccccaaccgtaattaacctaacaaccgaacgaaccgtcccgggtacggaaacgggggacccgtagtttacccaaccgtactccctacgaaaggaaacgaacctaaacttacccgaaacggtaaacctaaccgtaagtttacgttaactttaccttaaacctaaaaagttacgtaaaacttaaacccgttaggaaacggacgggaacccggaaacgggaaccgaaccgggacccgtaaacgttaggttaaactttaccggttaggttacggggttacgggggtacctttaaacggtttttaccgttacccggggtacccccggggttaccgggggggtaacccccgggggttaaaccccggttccggggttaccccgtacccccggttacccccgtacccccccgtaccccccgttacccccgaaaccccggtaaacccccggggg

SEQ ID NO: 418693 - DNA, 672 bp, Homo sapiens
  misc_feature: GZ8MTXP02FMW1C.21.78.H01.1.454.CMB.2.raw
tcagtcgtcgctcgcacgaccggtgctcgatttagtgtgagtagtttgggtttggggggagaggagcccagcactggaattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccaggcctccgaggggaacggccgtggagtggatctcactttatttatagtggtggtaccccacatactacacacgactccgtagaacgggccgtattccacatctacaagaaacgactaaattcccgaaaggaaacacgtaatttgtaattaccttacaaaaattcgaaaaacttaacccgtagacggaacggacccggaacgggaaccaccgggacctaaagttgtaaagtttacgtggttacggttgggggacttaacgttttacgtcccggtaaccccggtggggggaccccggggtaaaccctggggttaccccctaaccggttccccctacccccgaacccgttaccccgaaccggtaaacccggg

SEQ ID NO: 418694 - DNA, 607 bp, Homo sapiens
  misc_feature: GZ8MTXP02HJY6V.21.78.H01.1.454.CMB.2.raw
  modified_base (504)..(504): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagctgggtccgccaggctccgaggggaaggcctggagtggatcgtctacttattagtagtggtggtaccccacatactacacagactccgtgaacgggccgattccaccatctacagaaacgacaacttaccaaggaaactacaatttgtaacttacttacaaaatgaaactaaaccgtgaagacggaccgaaggacacggacctagtgtattacgngtaggtcgggctaacgtttacgtcggaccccgtgggggaccccgggtaaccctcgggtacccacccggtccctacccccgacccctcccgaacccggaaccgg

SEQ ID NO: 418695 - DNA, 563 bp, Homo sapiens
  misc_feature: GZ8MTXP02JZXHH.21.78.H01.1.454.CMB.2.raw
  modified_base (470)..(470): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaaggcctggagtggatctcacttatttatagtggtggtaccccacatactacacagactccgtgaagggccgattcaccatctcaagaagacaattccaaggaacacattgtatcttacaaaatgaaataactgagagccgagacacggcatgtatacnggtgtggggctacgtttacgtcgacccgtcgggggcccgggtaaccgtcgggtcccaccggtcctcccccgaccctcccgaaccgaacccggg

SEQ ID NO: 418696 - DNA, 761 bp, Homo sapiens
  misc_feature: GZ8MTXP02JKB16.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagttctcgtgggttcgtcaggtggcgactacagtgagcgtcgggtccgccgaggcctccggaaggggaacggccgtgggaggtggacttcgtactactttagtttagtaggtggtacggtaaccccaacgtaactaacctaaccgaacgtaacggtacccgttccgggtaagggaaaccgggggtccctaacgttacccgaaccctacttcctaaccgaaaggaaaccgtaaacccgtaaacgttacccgaaacgggtaaaacctaccgtaagttttacgtaacttaccttaaacctaaaagtacgtaaaacttaaaccgtagaacgacgggaccgaacggaccgacggacctaagttacgttaacgttacgtgggttacgggtacggggtaccttaacgtttaccggttaccgggtaccccgggtacgggggtaaccccgggtaacccgtcggtaccccgtacccgtcccctacccccgaccctacccgaaccggtaaccccgg

SEQ ID NO: 418697 - DNA, 600 bp, Homo sapiens
  misc_feature: GZ8MTXP02IC19O.21.78.H01.1.454.CMB.2.raw
  modified_base (434)..(434): a, c, t, g, unknown or other
  modified_base (441)..(441): a, c, t, g, unknown or other
  modified_base (468)..(468): a, c, t, g, unknown or other
  modified_base (474)..(474): a, c, t, g, unknown or other
  modified_base (512)..(512): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtcctgagactctcctgtgcagtctcgtgggttcgtcaggtggcgacacatgagcgtcggggtccgccgagggcctaccggaggggaacggccgtagggaggtgggacttctcgtaactttatttaagtaggtgggtaggtaaccccaacatactaacacaacgactccgtaggaaacgggcctattaccaccaatccanaagaaanacaatccaagaacatatatatctaaanaaatanaaatacgagagacgacgagacacgactatagtatacgngtcggtaggtactactttacgccgacccggtacggggtacccggtaccgtcggtaccacccgtcccaccccaccctaccgaacgaccg

SEQ ID NO: 418698 - DNA, 638 bp, Homo sapiens
  misc_feature: GZ8MTXP02GZ8CH.21.78.H01.1.454.CMB.2.raw
  modified_base (298)..(298): a, c, t, g, unknown or other
  modified_base (518)..(518): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccctgttgctatttcaaaaggtgtccagtgtgaggtgcagttggtggagactggaggaggcttgatccagccgtggggggtccctgagactctcctgtgcagtctctggggttcgtcagtggcgactacatgagctggggtccnccaggcctccgaggggaaggcctggagtggatctcactttattagtagtggtggtaccccacatactacacagactccgtagaacgggccgattccaccatcctacaagtaaacgactaaaacgttcccaaaggaacccaactagtttagtaactcttaacaaaattgaaaactaaccgtgaagacggccgaaggaaccacgggcctaagtgtattacgnggttcggtggggtactagttttaaccgtcggtaacccccgtgggggtaccccggggaaacccgtgggtacccgaacccggtttcccacccccgaccccgtcccgaacccgaaacccgggg

SEQ ID NO: 418699 - DNA, 649 bp, Homo sapiens
  misc_feature: GZ8MTXP02IBIC6.21.78.H01.1.454.CMB.2.raw
  modified_base (365)..(365): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacagtgagcgtgggtccgccgaggcctccggaggggaacgggcctagggagtggatctctacttatttatagtggtgtaccccanatactacacagactcgtagaacggcctattcaccatctacgaagaacgacaacttaccaaggaaacactaattgtaacttcttaacaaaattgaaaacttaaccgtagaacgacggaccgaggaaaccgaccgggcctaagttagttaacttaacgtggttaggtacgggggtctaaacgtttttacgacggtaacccccggtggggggaccccggggtaaacccgtcgggtacccaacccggttcctaccccccgtacccctacccgaacccggaacccgggg

SEQ ID NO: 418700 - DNA, 674 bp, Homo sapiens
  misc_feature: GZ8MTXP02HENVF.21.78.H01.1.454.CMB.2.raw
  modified_base (376)..(376): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtccctgagactctcctgtgcagtctcgtgggttcgtcgaggtggcgactacatgagcgtcgggtccgccgaggccgtccggaggggaacggccgtggagtggactctactactttattagtaggtggtacgtaccccanatacacacacgactcggtagaacggcctattccactatctacgaagaaacgactaacttccaaagaacactatttacgtaactacttaacaaaatgtaaaactaccgtaggaacgacggacccggaaaggaccgaccggtactaagttacggttaacttacggtgggttagggttacggggtactttaacgtttaaccggtccggaaccccggggtcggggggaacccccggtaaccgtcgggtaccccacccggttccccacccccgtacccgtaccccgaaacccggtaacccggg

SEQ ID NO: 418701 - DNA, 665 bp, Homo sapiens
  misc_feature: GZ8MTXP02HEOX8.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctccgaggggacggcctggagtggatctctactttattataggtggtacggtacccacatactacacagactcgtagaacgggccattcacatctacagaaacgactaacttaccaagaacactattagtactacttacaaaatagaaaacttaaccgtagaacgacggacccgaaggaccgacgggacctattacgttaactttaacgtgggttaggtacgggggtacttaacgttttaccgttacgggtaacccccgggttcggggggtaccccggggtaaacccgtcggggtaccccgtaaccccgggttccccctaccccccgtacccccgtaccccgaaacccggtaaccccgggg

SEQ ID NO: 418702 - DNA, 582 bp, Homo sapiens
  misc_feature: GZ8MTXP02HNSNZ.21.78.H01.1.454.CMB.2.raw
  modified_base (353)..(353): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaggcctggagtggatctcacttatttatagtggtgtaccccanatactacacagactccgtagaagggccagttccaccatcctcaagaacgaacaacttccaaggaaacacattacgtatacttacaaatgaaataacctagagagaccgagacacggccatgtattacgtgtagtggggtctacgtttactcgtacccgtcgggggacccgggtaacccgtcggtaccgaccggtcctacccccgtacccgtaccacccgtaaacccggg

SEQ ID NO: 418703 - DNA, 591 bp, Homo sapiens
  misc_feature: GZ8MTXP02GX9FS.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgaggggaggcctggagtggatctcactttattataggtggtggtaccccacatactacacagactccgtagaacgggccgattccaccatcacagaaacgacaacttcaaggaaacacattagtatacttacaaatagaaactaacctgagagaccgagaccacggccagtgtatacgtgtagtggggtactacgtttacgtacgtaccccggtcggggacccggggtaacccgtcggtaccgacccgtccctacccccgaccctcccgaaccgaacccgg

SEQ ID NO: 418704 - DNA, 557 bp, Homo sapiens
  misc_feature: GZ8MTXP02JY90L.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctcgagggagggcctggagtggatctcacttattatagtggtgtacccacatactacacagactccgtgaacgggccgattcacatctcaagaagacaattcccaaggaacactattagtactcttacaaatgaaatactgacgagccgagacacggccatgtatacgtgtggtgggctacttacgtcggaccccgtgggggacccgggtaaccctggtacccaccggtcctcccccgacctcccgaccgtaccgg

SEQ ID NO: 418705 - DNA, 622 bp, Homo sapiens
  misc_feature: GZ8MTXP02ISTW5.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccgaggggagggactggagtggatctcacttatttatagtggtggtaccccacatactacacagactccggtgaagggccgattccacatctcagaagacaattcccaaggaaacacgtatttagtaatcttacaaaattagaaactaaacctgacgagaccgaggacacggccaagtgtaattacgtggttacggtggggtactacgttttaccgttcggacccccggttaggggggacccccggggtaaacccgttgggtaccctaacccgggttccctaccccccgaaccccttcccgaaccccgtaaacccgggg

SEQ ID NO: 418706 - DNA, 612 bp, Homo sapiens
  misc_feature: GZ8MTXP02JM895.21.78.H01.1.454.CMB.2.raw
  modified_base (526)..(526): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtcgggtccgccgaggcctaccgaggggaacggggccgtaggaggtgggatctcaactttatttagtaggtggtcggtaccccactactaactacacacgactccgtagaacgggccgtattccgaccatctacaagaaacgacaaacttccaaggaactacgatttagtattacttaactaaatagtaaacttaaccgtgaacgacggaccgaaggacgacggctagtgtattacgngtggtggggactagtttacgtcggaccccgtgggggacccggtaaccgtggccaccgtcctaccccacccgtaccgacgaacccgg

SEQ ID NO: 418707 - DNA, 745 bp, Homo sapiens
  misc_feature: GZ8MTXP02JMWI4.21.78.H01.1.454.CMB.2.raw
  modified_base (537)..(537): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttctcgaggtggcgactacatgagcgtcgggtccgccgaggcctccggaaggggaacgggccgtagggaggtggacttctaccgtatttagtttaagtaggtggtacggtaacccccactaactaactaacgacaagtaccgtccgggtaggaaacgggtccgtattaccacctacttccacgaaaggaaacgaacctaaacttacccgaaaaggtaaacctactaagtttcgtaaacttaccttaacgtaaaaatcgtaaaacttaaccgngggaaacgacggaacccgggaaagaacccgaccgggtactaacggttaggttaacttacggttggtagggggttaccgggtacttaaacgttttaccggtaccggtaacccccggggtcggggggtaaccccggggtaacccgtcggtaaacccgtacccccgttcccggacccccctacccgtaccccgaaaaccggtacccccggg

SEQ ID NO: 418708 - DNA, 755 bp, Homo sapiens
  misc_feature: GZ8MTXP02HG3R9.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgctagtctcgttgggttcgtcgaggtcggcgactacatgagcgtcgggtccgccgaggccgtaccggaaggggaacgggccgtagggaggtcggattccgtactaactttaatttagtaggttggtacggtaacccccactaaattacctaacaacgacgtaccgttcccgggtagggaaacgggccctaacgttaccaacctattcctacaaaggaaacaacctaaacgttacccgaaaacgggtaaacctaactaagtttacggtaacttacccttaaacgaaaattagtaaaacttaacccgttaggaacgacgggaacccgaagggaacccacgggaccctaaagttcgttaacgtttacggtggttagggtacggggtacttaacgttttaccgtaccgggtaccccggtaccggggggtaaccccgggtaaacccgttcgggtaacccgtacccgttcccctaacccccgtacccgtacccgaacccggaacccggg

SEQ ID NO: 418709 - DNA, 594 bp, Homo sapiens
  misc_feature: GZ8MTXP02JXP8T.21.78.H01.1.454.CMB.2.raw
  modified_base (497)..(497): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaagggcctggagtggatctctacttattatagtggtggtaccccacatactacacagactccgtagaaacggggtccgtaattaaaccatcctacaagaaacgaacaaacttaccgaacggaaacacaattgtaattcttacaaatagaataacctgagagacgagacacggcatgtatagtgngtggggactatttacgtcgtacccgtcgggggacccgggtaaccgtcggtccgtacccgtcccgtacccccaccccgtaccgacccgaacggccccg

SEQ ID NO: 418710 - DNA, 577 bp, Homo sapiens
  misc_feature: GZ8MTXP02GAR7T.21.78.H01.1.454.CMB.2.raw
  modified_base (338)..(338): a, c, t, g, unknown or other
  modified_base (400)..(400): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaaggcctggagtggatctcacttattanagtggtggtacccacatactacacagactccgtgaaagggccgaattcaccatctcaagaanacaaattccaaggaaacacattgtatacttcaaaattgaaataaacctagagagacgaacgacgacggaccatagtattactagtgtgggcgtattacttacgtacccgtacggggccgggggaacccggtaacggtcgaacccggtcctaccccacccctacccaccgaaacccgg

SEQ ID NO: 418711 - DNA, 580 bp, Homo sapiens
  misc_feature: GZ8MTXP02IUK71.21.78.H01.1.454.CMB.2.raw
  modified_base (296)..(296): a, c, t, g, unknown or other
  modified_base (385)..(385): a, c, t, g, unknown or other
  modified_base (391)..(391): a, c, t, g, unknown or other
  modified_base (393)..(393): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccnccaggctccgagggaggcctggagtggactctctactttattatagtggtggtacccacatactacacagactcgtgaggccgatcacntctcananacaatccagaacactattgtatctacaaatagaaataacctgagacgaccgagacacggctatagttatactgtcggtaggggtactacgtttaacctcggtaccccggtacgggggccccgggggtaaaccctcgggtacccaacccgttcccctacccccgaccctacccgaacccgaacccggg

SEQ ID NO: 418712 - DNA, 659 bp, Homo sapiens
  misc_feature: GZ8MTXP02HAZ2T.21.78.H01.1.454.CMB.2.raw
  modified_base (445)..(445): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgttgggttttccttgttgcttatttacgaaaaggtgtccagtgtgaggtgcagttggtggagacgtggaggaggtcttgatccgagccggtcgggggtccctgagactctcctgtgcagtctcgttgggttcgtcgaggtggcgtactacagtgagtcgtcgggtcccgccgaggcctaccggaaggggaacggtccgtagggaggtggatcctactactttattagtaggtggtacgtacccatactactacacacgtacgtccgtaggaacggtccgtattccaactatcccgtanaagaaacgaactaacttacccgaaagaaacctacgtagtttacgtaactactttaacaaagttagtaaaactaccgtagacgacgaccggaagaccacggacagttgtaatcgtgtcggtggtacttacgtttacgcggtaccccggtcgggggaccccggtaacgtcggtaccgtacccggtccctcccccgacccgtccgaaccggacccgg

SEQ ID NO: 418713 - DNA, 670 bp, Homo sapiens
  misc_feature: GZ8MTXP02GCJ0G.21.78.H01.1.454.CMB.2.raw
  modified_base (302)..(302): a, c, t, g, unknown or other
  modified_base (365)..(365): a, c, t, g, unknown or other
  modified_base (376)..(376): a, c, t, g, unknown or other
  modified_base (409)..(409): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtggttttccgtgttaggctattacaaaaggtgtccagtgtgaggtgcagttggtggagactggaggaggcttgatccagccgtggggggtccctgagactctcctgtgcagtctctgggttcgtcagtggcgactacatgagcgtggggtccnccgaggcctccgaggggaaggcctggagtggatctcactttatttagtagtggtgtaccccanatactacacanactccgtgaagggccattcacatcacagaacanaacttccaaggaaaccataattgtaatctttacaaaattcgaaaacttaaccgtagaacgaacggaccggaaaacggtaccgaaccgggtacccaaatttacggttaatttaaccgtgggtaacggttgggggtacctaaagtttttaaccgttcggaacccccgggttggggggacccccgggggtaaaaccctggggttaccccaacccgggtttccccaccccccgtaacccctacccgaacccggaaaaccccgggg

SEQ ID NO: 418714 - DNA, 584 bp, Homo sapiens
  misc_feature: GZ8MTXP02HCU1A.21.78.H01.1.454.CMB.2.raw
  modified_base (356)..(356): a, c, t, g, unknown or other
  modified_base (365)..(365): a, c, t, g, unknown or other
  modified_base (392)..(392): a, c, t, g, unknown or other
  modified_base (398)..(398): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaggcctggagtggatctctacttatttatagtagtggtaccccanatactacanagactccgtgaacgggccatcacatcncagaanacaatccagacacatagtatctacaaatgaaactaacctagagacgacgaggacgacggcagtgtattacgtgtggtcggggtctaacgtttacgttacggtacccccgtcgggggaccccggggtaacccgtggtcccgtaacccgtcccgtacccccaccccgtacccgaacccgaacccgggg

SEQ ID NO: 418715 - DNA, 580 bp, Homo sapiens
  misc_feature: GZ8MTXP02JJ119.21.78.H01.1.454.CMB.2.raw
  modified_base (478)..(478): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtggggtccgccgaggcctccgaggggaagggcctggagtggatcgtcacttatttatagtggtggtaccccacatactacacagactccgtgaacgggccgattcaccatctcagaaagacaattccaagaacacattgtatctacaaatgaaatacctagagagacgagacacggcatgtattacgngtggtgggctacgttacgttacgaccccgtcgggggacccgggaacccgtcggtacccacccggtcctacccccgaccccgtacccgacccgtaaacccggg

SEQ ID NO: 418716 - DNA, 545 bp, Homo sapiens
  misc_feature: GZ8MTXP02GWZSB.21.78.H01.1.454.CMB.2.raw
  modified_base (471)..(471): a, c, t, g, unknown or other
  modified_base (524)..(524): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctcgtgggttcgtcagtggcgactacatgagcgtgggtccgccaggctccgaggggaaggcctggagtggatcgtcactttatttatagtggtggtaccccactatactacacagactccgtagaacggccgattcacatctcagaagacaattcaagaacacatgatcttacaaaatgaaataacctgagagcgagacacggacatgtattacngtggtgggctattacgtcgaccccgtggggcccggaacctggtccaccgtccnccccacctcccacgaacccgg

SEQ ID NO: 418717 - DNA, 625 bp, Homo sapiens
  misc_feature: GZ8MTXP02GDAG0.21.78.H01.1.454.CMB.2.raw
  modified_base (279)..(279): a, c, t, g, unknown or other
  modified_base (294)..(294): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggtttcgtgtaggctattacaaaggtgtccagtgtgaggtgcagttggtggagactggaggaggcttgatccagcctggggggtccctgagactctcctgtgcagtctcgtgggttctcagtggcactanatgagcgtcggtccncgaggctacggagggacggcgtggagtgactctactactttattagtaggtggtacgtacccatatacacacagtacgtcggagaacgggtcctacttaccactatacacaaagtaagaactaactacgaacgaacactacttattacttacttaactaaagtaacgtaaactaacgtaagacgacgacgacgacgacgacgtacgtagtagttacgtggtcggtacgggtacgtacgttacgttaccggtacccgggtaccggggtaccgggtaccggtaaccggtaccgtacccgtaccctaccccgtacccgtacccgtaccgaaccg

SEQ ID NO: 418718 - DNA, 563 bp, Homo sapiens
  misc_feature: GZ8MTXP02G2A0Z.21.78.H01.1.454.CMB.2.raw
  modified_base (429)..(429): a, c, t, g, unknown or other
  modified_base (529)..(529): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagcctggggggtccctgagactctcctgtgcagtctctgggttcgtcagtggcgactacatgagctcggggtccgccaggcctccgaggggaaggccgtggagtgggatctcactttattatagtggtgtaccccacatactacacagactccgtgaaagggcccgattccaccatctacagaaacgacaattcccaaggaacanacttgtatcttacgaaatgaaataacctgagagaccgaggacacggcatgtatactggtagtggggctagtttactcgacccgtcggggaccgggtaccnggtccaccggtctccccaccctccacgaacccgg

SEQ ID NO: 418719 - DNA, 592 bp, Homo sapiens
  misc_feature: GZ8MTXP02F5Y4K.21.78.H01.1.454.CMB.2.raw
  modified_base (296)..(296): a, c, t, g, unknown or other
  modified_base (355)..(355): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggtccctgagactctcctgtgcagtctctgggttcgtcagtggcgactacatgagctgggtccnccaggctccgagggaagggcctggagtggatctcactttattatagtggtggtacccanatactacacagactccgtagaagggccgattcaccatctcagaaagacaatccagaaacacattagtatactacaaaatagaaataacctgagagaccgaacggacacggccagtcgtattacgtagtggtagggggcacgttttacttacggtaccccgtaccgggggccgggggaaacccctgggtccgaacccggttccctccccctaacccgtcccgaaccgaaaccccgggg

SEQ ID NO: 418720 - DNA, 582 bp, Homo sapiens
  misc_feature: GZ8MTXP02JJ5UK.21.78.H01.1.454.CMB.2.raw
  modified_base (259)..(259): a, c, t, g, unknown or other
  modified_base (273)..(273): a, c, t, g, unknown or other
  modified_base (301)..(301): a, c, t, g, unknown or other
  modified_base (445)..(445): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccgaggccgtgggggtccctgagactctcctgtgcngtctcgtgggttcncagtgcgactacatgagcgtgggtcccnccgaggctccgaggggaggcctggagtggatcgtctaactttattataggtggtcgtaaccccactatactacacagactccggtgaacggccgtattccacatcacagaagacctatccgaagaaacactattgtatccttanaaaatgaaactaaccgtgagacgccgagaccacggcatgtaatcgtagtgtgggcttattacgtcggaccccggtcgggggacccggtaacctgggtcccacccggtcctacccccgaccctccgaaccgaacccgg

SEQ ID NO: 418721 - DNA, 587 bp, Homo sapiens
  misc_feature: GZ8MTXP02HQWAO.21.78.H01.1.454.CMB.2.raw
  modified_base (362)..(362): a, c, t, g, unknown or other
  modified_base (371)..(371): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgccaggcctccgaggggaacggcctggagtggatctcactttattataggtggtcgtacccanatactacanagactccgtagaagggccgattccaacctatctaccagaaacgacaaacttccaagaaacactaattagtatacttacaaatgaaataacctagacgagaccgaggacgacggccatagtattactgtgtggggtctacgtttacgtacgacccgtcgggggacccggaaccgtcggtaccaccggtcctaccccgaccctccgaccgaacccggg

SEQ ID NO: 418722 - DNA, 686 bp, Homo sapiens
  misc_feature: GZ8MTXP02FUTXT.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcagtggcgactacatgagcgtgggtccgccgaggctccgaaggggaagggccgtggaggtgggatctcactttatttatagtggtggtaccccacataactacacagactccgagaagggccgtacttcaaccactctaccaagtaaacgactaaacttacccgaaggaaaccaacctatttacggtaattaccttactaaaaattagaaaacttaaacccgtgaaggaaccgaccggaacggaccgaacgggccctaatagggttacttaacgtggttaggtgggggtacttacgtttaaacgttcggtaacccccgtcggggggaccccggggtaaaccccggttcgggtaaccccgtaaccccgggtccctacccccccgtaacccgttaccccacccggtaaaaccccggggg

SEQ ID NO: 418723 - DNA, 595 bp, Homo sapiens
  misc_feature: GZ8MTXP02HNHLG.21.78.H01.1.454.CMB.2.raw
  modified_base (368)..(368): a, c, t, g, unknown or other
  modified_base (399)..(399): a, c, t, g, unknown or other
  modified_base (436)..(436): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaaggcctggagtggatctcgactttatttatagtggtcgtaccccacatactacanagactccggtgaaagggccgattcaccatcncagaacgacaattccaaggaacacattgtatccttanaaaatgaaactaacctgaagacgaccgagacacggcatgtaattcgtgtagtggggtactaacgtttacgttcggacccccgttgggggacccccgggaacccgtcggtacccgacccgttcccgtacccccaccccgttacccaacccggaaacccgg

SEQ ID NO: 418724 - DNA, 626 bp, Homo sapiens
  misc_feature: GZ8MTXP02JZQ39.21.78.H01.1.454.CMB.2.raw
  modified_base (297)..(297): a, c, t, g, unknown or other
  modified_base (509)..(509): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagccgtggggggtccctgagactctcctgtgcagtctctgggttcgtcagtggcgactacatgagctgggtccncaggctccgagggaggcctggagtggatctcacttattatagtagtgtaccccagatactacacagactccgtaggaacggtccgattcactatcctcaagaaacgactaaattacccgaaggtaacaactatttacgtaattcctttaacaaaacgttgaaaactaaccgtgaacgaggacccgaaggaccacgggccagtgttaattacnggtaggtcggggtactacgtttaaccgtcgtaccccgtcgggggtaccccgggtaacccgtcgggttcccaacccggttcctaccccccgacccgtacccgaacccgtaacccgggg

SEQ ID NO: 418725 - DNA, 608 bp, Homo sapiens
  misc_feature: GZ8MTXP02IVN0E.21.78.H01.1.454.CMB.2.raw
  modified_base (359)..(359): a, c, t, g, unknown or other
  modified_base (485)..(485): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggcctccgaggggaagggcctggagtggatctcactttattatagtggtggtaccccanatactacacagactccgtgaaacggccgattcaccatctcagaaagacaattccaagaaacacaattgtatacttacaaaatgaaataacctgagagaccgaagacgacggccagtacgtattacnggttcggtggggctagtttaccgttcggaccccgtcgggggtaccccggggaaacccgttgggtaccccgtacccggttccctaccccccgtaccccgttaccccgacccgaaaccccggggg

SEQ ID NO: 418726 - DNA, 619 bp, Homo sapiens
  misc_feature: GZ8MTXP02G9ED8.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggcctccgagggaggcctggagtggatctcgacttatttatagtggtggtacccactatactacacagactccgagaacgggccgattcaccatctcagaacgacaattcccaaggaacactattgtatcttacaaatcgaaatacctagagagccgaaggacacggcctaagtggtaattacgtggttacggtgggggacttacgtttacgtaccggtacccccgttacgggggggacccccgggtaaacccgtcgggtacccgtaaccccggttccctaccccccacccgttacccccgaacccgtaaaccccgggg

SEQ ID NO: 418727 - DNA, 601 bp, Homo sapiens
  misc_feature: GZ8MTXP02HB2QJ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccaggggaagggcctgggagtggatcgtctacttatttatagtggtggtaccccacatactacacagactccgtgaagggccgattcacatctacagaaagacaaattccaaggaacacattgtatctcaaaatgaaataacctgagagaccgaggacacggccatgtattactggtagtggggctacgttttacgtcggacccccgttcgggggacccccgggggtaaaccctcgggggttaccacccggttacccctacccccgacccccgttccccaaccccggaaacccgggg

SEQ ID NO: 418728 - DNA, 593 bp, Homo sapiens
  misc_feature: GZ8MTXP02HQDWX.21.78.H01.1.454.CMB.2.raw
  modified_base (364)..(364): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcggggtccgccgaggcctccgaggggaacggcctggagtggatctcactttattatagtggtggtaccccanatactacacacgactccgtgaaagggccgattcaccatctacaagaaagacaacttccgaagaaacactattgtaatcttacaaatgaaataacctgaagacgccgaggacacggccatgtatactggtcggtggggactacgtttacgttcggacccccgtgggggaccccgggtaaccctcgggtaccacccggttccacccccgaccctcccgaaccgaacccggg

SEQ ID NO: 418729 - DNA, 572 bp, Homo sapiens
  misc_feature: GZ8MTXP02JFLEE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaaggggcctggagtggatctctacttattatagtggtggtacccacatactacacagactccggtagaacggggccgattccaccatctacaagaagacaattccaagaacacattgtatcttacaaatgaaataactgagagcgagacacggcatgtatcgtagtggtgggctacgtttactcggacccgtacgggggcccgggtaaccctgggtcccacccggtccctacccccgaccctacccgaccgtaaccggg

SEQ ID NO: 418730 - DNA, 555 bp, Homo sapiens
  misc_feature: GZ8MTXP02JEO40.21.78.H01.1.454.CMB.2.raw
  modified_base (430)..(430): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaggcctggagtggatctcactttatttatagtggtggtaccccacatactacacagactccgtgaagggccgattcaccatctcagaagacaattccaaggaacacgattgtatacttanaaaactgaaataacctgagagaccgagacacggcatgtatacgtgtcgtgggactattacgtcgacccgtcgggggacccggtaaccgtggtccaccggtcctccccaccctccgaccgaaccgg

SEQ ID NO: 418731 - DNA, 571 bp, Homo sapiens
  misc_feature: GZ8MTXP02J0RR9.21.78.H01.1.454.CMB.2.raw
  modified_base (550)..(550): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagcctggggggtccctgagactctcctgtgcagtctctgggttcgtcagtggcgactacatgagctggggttcgccaggctccgaggggaaggggcctgggagtggatctcacttatttatagtggtggtaccccacatactacacagactccgtgaagggccattcaccatctcagaagacaattccagaacacattgtatcttacaaatgaaataacctgagacgccgaggacacggccagtcgtatactgtggtggggctagtttacgtcgtaccccgtcgggggcccggggaaccctcggtaccgacccggtccctacccccnccctaccccaccgaacccggg

SEQ ID NO: 418732 - DNA, 600 bp, Homo sapiens
  misc_feature: GZ8MTXP02HMYBF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggcctccgaggggaacgggcctgggagtggatctcactttatttatagtggtgtacccacatactacacagactccgtagaaacgggccgattccaccatctacaagaacgacaattccaaggaaacactatttgtaattcttacaaaatgaaaactaacctagagacgacccgaggaccacgggcctatagttattacgtggtaggtggggtactagtttaccgttcggacccccggtgggggtaccccggggaacctcggtccacccggtcctacccccaccctaccgacccgaccgg

SEQ ID NO: 418733 - DNA, 564 bp, Homo sapiens
  misc_feature: GZ8MTXP02I4W0C.21.78.H01.1.454.CMB.2.raw
  modified_base (536)..(536): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaagggcctggagtggatctcacttatttatagtggtggtaccccacatactacacagactccgtgaagggccgattcaccatctcagaagacaattccagaacacattgtatctcaaaatgaaatacctgagagaccgaggacacggccatgtatactgtagtggggactatttacgtcggtcccccgtgggggccccgggtaaaccgtggtccgtaccgtccncccccacccgtcccaacccgaacccggg

SEQ ID NO: 418734 - DNA, 603 bp, Homo sapiens
  misc_feature: GZ8MTXP02FSG00.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccagggctccgagggaaggcctggagtggatctcactttatttatagtggtggtaccccactatactacacagactccgtgaacgggccattccacatctcagaagacaattccaagaacacattgtatactacaaatgaaataacctgagacgaccgaaggacacggaccatgtaattacgtggtggtcgggggtactacgtttaccgttacggtacccccggttacgggggcccggggtaaaccccgtgggtacccgaaccccggttccctacccccaccccgtcccaacccgtaaacccgggg

SEQ ID NO: 418735 - DNA, 595 bp, Homo sapiens
  misc_feature: GZ8MTXP02ICH3A.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtcccgccaggctccgaggggaagggccctgggagtgggatctctacttatttatagtggtggtaccccacatactacacagactccgtgaagggccgattccaccatctcagaagacaattccaagaacactattgatctacaaaatgaaataacctgaagagaccgaggacacggccaatcgtattacgtgtgtaggggtctagttttacgtacggtacccccgtgggggtaccccgggaacccgtcgggtacccaacccggtccctacccccgaccccgttacccgaacccgaacccggg

SEQ ID NO: 418736 - DNA, 571 bp, Homo sapiens
  misc_feature: GZ8MTXP02JFJS5.21.78.H01.1.454.CMB.2.raw
  modified_base (545)..(545): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctggggtccgccgaggctccgaggggaaggggcctgggagtgggatctcactttattatagtggtggtaccccacgatactacacagactccgtgaaagggccgattccacatctacagaagacaattccagaacacattgtatctacaaatgaaataacctgagagccgaggacacggccatgtatacgtgtgtggggctacgtttacgttcggaccccgtgggggacccggtaacccgtggttcccacccggttccncccccgtaccctccgaccgaaccggg

SEQ ID NO: 418737 - DNA, 592 bp, Homo sapiens
  misc_feature: GZ8MTXP02F41CV.21.78.H01.1.454.CMB.2.raw
  modified_base (342)..(342): a, c, t, g, unknown or other
tcagtcgtcgctcgcacgaccggtgctcgatttagtgtgagtagtttgggtttggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctggggtccgccaggctccgagggaaggcctggagtggatctcacttatttanagtggtggtaccccacatactacacagactccgtgaacgggccgattccacatctacagaagacaaattccaaggaaacacattgtatcttcaaaatgaaataacctgagagccgagacacggcaagtgtatacgtgtgtggggactagtttacgttcggacccccgttgggggaccccggggaaacccgtggggtacccaacccgggttccctaccccccgaacccttcccgaacccgtaaacccgggg

SEQ ID NO: 418738 - DNA, 556 bp, Homo sapiens
  misc_feature: GZ8MTXP02IOVZP.21.78.H01.1.454.CMB.2.raw
  modified_base (479)..(479): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtcccgccaggctccgaggggaaggcctggagtggatcgtctacttatttatagtggtggtaccccacatactacacagactcgtagagggccgattcacatctcagaagacaattccaaggaacactattgtaatctacaaatgaaataacctgagagccgagacacggcatgtatactgtgtgggntactttactcgccccgtacgggggcccgggtaaccgtggtaccacccggtcctcccccacctcccaccgtaaccggg

SEQ ID NO: 418739 - DNA, 568 bp, Homo sapiens
  misc_feature: GZ8MTXP02FKAXD.21.78.H01.1.454.CMB.2.raw
  modified_base (475)..(475): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctcactttatttatagtggtggtaccccacatactacacagactccgtgaagggccgattcacatctacagaagacaattcccaaggaacacattgtatcttacaaaatgaaataacctgagacgaccgaggacacggccatgtatacngtaggtggggctatttacgtcgaccccgtgggggcccgggaacccgtgggtcctacccgtccctacccccgaccctacccaccgtaacccggg

SEQ ID NO: 418740 - DNA, 630 bp, Homo sapiens
  misc_feature: GZ8MTXP02JM8LR.21.78.H01.1.454.CMB.2.raw
  modified_base (301)..(301): a, c, t, g, unknown or other
  modified_base (363)..(363): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtggggtcccnccaggcctccgaggggaacggcctggagtggactctcactttattatagtggtgtaccccanatactacacagactcgtagaacgggccgtatcaccatctacgaagaacgaacaacttacccgaaaggaaacacgaatttgtactacttaacaaaatagaaacttaaaccgtagaacgacggaccggaagaccgacggaccagtgtaattacgtggtggtacggggataacgtttaccgtacggtaccccggtcgggggtacccgggtaacccgtgggtacccgacccgttcccctacccccgacccttacccgaaccgtaacccggg

SEQ ID NO: 418741 - DNA, 536 bp, Homo sapiens
  misc_feature: GZ8MTXP02IUQFV.21.78.H01.1.454.CMB.2.raw
  modified_base (521)..(521): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggagggcctggagtggatctcacttattatagtggtggtaccccacatactacacagactccgtagaacggggccgattccaccatcctcagaagacaattccagaacacattgtatcttacaaatgaaataacctgagagccgaggacacggccatgtatactgtgtgggctattactcgacccgtggggccgggacctggccacgtccncccacctccacacgg

SEQ ID NO: 418742 - DNA, 612 bp, Homo sapiens
  misc_feature: GZ8MTXP02GJ0GR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgagggaacgggcctggagtggatctctactttatttataggtggtcggtaaccccactaatactaacacacgactccgtaggaacggccgtacttcaacctatctacagtaaacacaaacttacaaggaaacacgtaattagtaataccttaaacaaatactaaataacagacgacgacgaacgacacgacatatatacgtgtaggtcggtacttacgttacgtaccggtacccggtacgggggacccggtaaccgtcggtacccgtaccgtcccacccctaccctacccgaaccgtaccgg

SEQ ID NO: 418743 - DNA, 634 bp, Homo sapiens
  misc_feature: GZ8MTXP02GAUNX.21.78.H01.1.454.CMB.2.raw
  modified_base (406)..(406): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccgagggaacggcctggagtggatctctactttatttagtagtggtggtaccccacatactacacagactccgtagaaggggccattccacatcctanagaagacaattaccgaagaacactattagtactacttacaaatagaaactaacctgaacgacggaccgaaggacgacggacctagtacgtattacgtggtggtacggggacttagtttaccgttacggtacccccggtcgggggtaccccgggggtaacccgtcgggtacccgtaaccccggttcccctaccccccgtaccccctaccccgaaccggaaaccccgggg

SEQ ID NO: 418744 - DNA, 595 bp, Homo sapiens
  misc_feature: GZ8MTXP02F18R3.21.78.H01.1.454.CMB.2.raw
  modified_base (384)..(384): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtggggtcccgccgaggcctccgaaggggaacggggcctgggagtggatctctactttatttatagtggtggtaccccacatactacacggganactccgtagaacgggccgattcaccatctacagaagacaatacaagaacacattagtatacttacaaaatagaaactaacctagaagacgaccgagacacggccatagtattactgtggtggggactacgtttacgtacggtacccgtcggggtaccggggaaccgtcggtaccgaccgtccctaccccctacccgtacccaccgaaccgg

SEQ ID NO: 418745 - DNA, 647 bp, Homo sapiens
  misc_feature: GZ8MTXP02FN2KS.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtccgccgaggcctccgaggggaacgggcctggagtggatctctactttatttataggtggtggtaccccacatactacacagactccggtagaacgggccgattccaccatctacaagaaacgacaacttccaaaggaacactattgtatacttacaaaatagaaataaccgtgaagacgaccgaaggacacggcctagtgttaagttacgtaggttcggtacgggggtacttaacggttttaccgtaccggtacccccggtcggggggaccccggggtaaaccccgttcgggtacccgtaacccggttcccctacccccgaccccgtccccgaaacccggtaacccgggg

SEQ ID NO: 418746 - DNA, 710 bp, Homo sapiens
  misc_feature: GZ8MTXP02HV1US.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtgggtccgccgaggcctccgaggggaacggccctgggagtggatcgtctactttattatagtggtgtaccccacatactacacacgactccgtgaaacgggccagttccacatctacaagaaagacaattaccaaggaacacgtaatttcgtaattacttactaaaatgtaaaacttaaaccgttaggaagacggacccgaaagggaaccgaaccgggaccctaagttaggtaaattttaccgtagggttgggttacgggggtactttaacgtttttaaacccggttcggtaaacccccccggggttacggggggtacccccgggggtaaaccccgttcggggttaccccgtaccccggtttacccccgtacccccctaacccccgttaccccgaaccccggtaaacccccggggg

SEQ ID NO: 418747 - DNA, 560 bp, Homo sapiens
  misc_feature: GZ8MTXP02JYW97.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaggcctggagtggatctctacttattatagtggtgtaccccacatactacacagactccgtgaacgggccgattccacatctacagagacaatccaagaacacattgtatctacaaatgaaatactgagagaccgagacgacgcatgtattgtgtggtgggctacgtttcgtcggacccgtcgggggacccgggtaccgtcggtcccacccgtaccctcccccacccgtacccgaccgaacccggg

SEQ ID NO: 418748 - DNA, 690 bp, Homo sapiens
  misc_feature: GZ8MTXP02G16TY.21.78.H01.1.454.CMB.2.raw
  modified_base (361)..(361): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtccgccgaggctccgagggaggcctggagtggatcgtctactttattagtagtggtgtaccccanatactacacagactccgtagaacgggcctagttccacatcctacaagtaaacgactaaattccgaaaggaaaccactagtttacgtaacttcttaacaaaatggaaaattaacccgtagaacggaccggaccgaaaggaccaacgggccctaagttcggttaactttacgtgggttagggtacgggggtaccttaacgtttttacggtaccggtaaccccccgggttggggggtaacccccggggaaacccgttcggggttacccccaaccccggtttccccgacccccccgtaaccccgtacccccgaaacccggtaaacccccgggg

SEQ ID NO: 418749 - DNA, 584 bp, Homo sapiens
  misc_feature: GZ8MTXP02G108I.21.78.H01.1.454.CMB.2.raw
  modified_base (411)..(411): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagctcgggtccgccgaggcctccgaggggaacgggcctggagtggatctcactttattatagtggtggtaccccacatactacacacgactccggtagaacgggccgattccaaccattcccanaagaaaacgtacaaacttcccgaaggtaaaccactattacgtaatacttacaaaatgaaataacctgagagaccgagacacggcatgtatactggtggtgggctagtttctcggaccccgtgggggacccggaaccgtggccacccggtccacccccacctccacgtaaccgg

SEQ ID NO: 418750 - DNA, 579 bp, Homo sapiens
  misc_feature: GZ8MTXP02H9RJT.21.78.H01.1.454.CMB.2.raw
  modified_base (480)..(480): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagcgtgggtcccgccaggcctccgaggggaaggccgtggagtggatctctacttatttatagtggtgtacccacatactacacagactccgtgaacggccgattcaccatctacagaagactaattcccaagaaacactattagtactcttacaaatgaaataacctgagagcgagacacggcatgattacnggtgtgggtactacgtttacgtcggaccccgtgggggtaccccgggaacccttcggacccacccggtccctccccgaccccttaccacccgaacccggg

SEQ ID NO: 418751 - DNA, 726 bp, Homo sapiens
  misc_feature: GZ8MTXP02HYKGT.21.78.H01.1.454.CMB.2.raw
  modified_base (362)..(362): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagcgtggggggtcctgagactctcctgtgcagtctcgtgggtctcgagtggcgactacatgagcgtgggccgccaggctccgagggaaggcctaggagtggatctactacttatttaataggtggtacgtaaccccanaacttaacacacagacctccgtagaaacggggccctaattcaacccataccctacgaaaggaaacaactaaaacttaccccggaaggtaaaaccaacctaattttacgtaaactttacctttaaaacgtaaaattaaacgtaaaacttaaaccggtaggaaacggacgggaaccggaaacgggaaaccgtaaccgggacctaaagttagttaaacgttacggttggtacggggttacggggtacttaacgtttaccggtacccggtaccccggggttacggggggaaccccgggtaacccgtcgggtacccgtaccccgttcccctaccccccgtaaccccgtacccgaaacccggtaacccgg

SEQ ID NO: 418752 - DNA, 565 bp, Homo sapiens
  misc_feature: GZ8MTXP02JOBOM.21.78.H01.1.454.CMB.2.raw
  modified_base (465)..(465): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaaggcctggagtggatctcacttattatagtggtggtaccccacatactacacagactccgtgaagggccgattcaccatctcagagacaatcagaacacattgtatctacaaatgaaataacctgagacgcgagacacggcatgtattacnggtagtggggactagtttaccgtcgaacccccgtgggggaccccggggtaaccctggtacccgacccgtcctacccccgaccctacccacccgaacccgg

SEQ ID NO: 418753 - DNA, 631 bp, Homo sapiens
  misc_feature: GZ8MTXP02GGNYK.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcggggtcccgccgaggcctccggaggggaacgggccgtggaggtggatcgtctactttatttagtaggtgggtacggtaaccccactatactaacacagtacctccggtagaacgggccgaattccaacctatctacaagaagaacaaattccaagaacactattagtatacttacaaaatagaaataacctgagacgaccgaagacacggacagtgtaattacgtgtggtggggactaacgtttacgttacggaccccggtacgggggaccccgggtaaacccgtcggttacccacccggttcccctacccccaccccgtacccgacccgaaacccggg

SEQ ID NO: 418754 - DNA, 849 bp, Homo sapiens
  misc_feature: GZ8MTXP02HZG7Q.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtcctgagactctcctgtgcagtctcgttgggttcgtcaggtggcgactacagtgagcgtcgggtccgaccagggcctaccggaaggggaacgggccgtagggaggtggatcctacgtactttaatttagtaggtgggtacggtaaccccactaattacctaacaactacgaccttccgggtagaaacggggccctaacgtttaccaaccctattaccctaacgaagaaaacgtaactaaaacgtttacccgaaacggggtaaaacctaacctaaagttttacggtaaactttaccctttaaactaaaaaatttaggaaaactttaaaaccccgttaggaaaccgggtaacgggaccccggaaagggaaacccgaaccggggtaaccctaaagtttaacggtttaattttaaaccggttagggttcggggttaacggggggttacctttaaacggtttttaacccggttaccggttaaacccccccggggttcgggggggtaacccccgggggttaaaacccccgttccgggggttaccccgtaaacccccggttcccccggtaacccccccgttaacccccgtaccccgtaaaacccccgggtaaaccccggg

SEQ ID NO: 418755 - DNA, 612 bp, Homo sapiens
  misc_feature: GZ8MTXP02GDFBJ.21.78.H01.1.454.CMB.2.raw
  modified_base (268)..(268): a, c, t, g, unknown or other
  modified_base (293)..(293): a, c, t, g, unknown or other
  modified_base (325)..(325): a, c, t, g, unknown or other
  modified_base (399)..(399): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcgtggtttcgtgtaggctattacaaaaggtgtcagtgtgaggtgcagttggtggagactgggaggaggcttgatccagccgtggggggtccctgagctctctgtgcagtctcgtgggttcgtnagtggcactacatgagctgggtccnccaggctccgaggggaggcctggagtggatcncatttatttatagtggtacgtaccccaacatactaacacagactccggtgaaaggggtccaattcaacctatcncaagaaacaacaattcccgaaagtaaaccataaatttgtaactacttaaacaaagttacgaaacgtaacgtagagacgacgaacgacgacgacgactagtagttagtagtcggtcggtacgtacttacgttacggtaccggtaccggggtaccgggtaccggtaaccggtacccgtaccgtacccgtaccccgtaccctacccgaccgaccgg

SEQ ID NO: 418756 - DNA, 578 bp, Homo sapiens
  misc_feature: GZ8MTXP02I7MMT.21.78.H01.1.454.CMB.2.raw
  modified_base (356)..(356): a, c, t, g, unknown or other
  modified_base (498)..(498): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagctctcctgtgcagtctctgggttcgtcagtggcgactacatgagcgtgggtcccgccaggctccgaggggaggcctggagtggatctcacttatttatagtggtggtaccccanatactacacagactccggtagaaacggggccgtattccacctatcctacgaagaaagacaaattcccgaagggaaaaccacgtaattgtaacttcttacaaaatgaaactaacctgacgagccgagacacggcatgtatacngtggtcgggctatttcgcgaccccgtgggacccgaggtaacccgtggtactacccggtcctacccccacctaccaacccg

SEQ ID NO: 418757 - DNA, 564 bp, Homo sapiens
  misc_feature: GZ8MTXP02HJLTF.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaacggcctggagtggatctcactttatttatagtggtgtaccccacatactacacagactccgtagaagggccgattcacatctacagaagacaattcccaaggaacacgattgtatcttacaaatgaaatactgagagccgaggacacggcagtgtatacgtgtggtgggctagtttactcggaccccgtgggggacccggtacctgggtccacccggtcctacccccgaccctccgacccgtaaccggg

SEQ ID NO: 418758 - DNA, 574 bp, Homo sapiens
  misc_feature: GZ8MTXP02ID1T2.21.78.H01.1.454.CMB.2.raw
  modified_base (298)..(298): a, c, t, g, unknown or other
  modified_base (396)..(396): a, c, t, g, unknown or other
  modified_base (401)..(401): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccnccaggctccgagggaggcctggagtggatctctacttattatagtggtgtaccccacatacacacagactccgtagaacggccgattccacatccganagaanacatacaagacactattatatactacaaatagtaaactaacgtagagacgaccgagacgacgtacatagtactacgtgtcggtggtacttactttacgtaccggtacccggtcggggtacccggaccgtcggtcccgacccgtccctacccctaccctacccgaaccgaccgg

SEQ ID NO: 418759 - DNA, 592 bp, Homo sapiens
  misc_feature: GZ8MTXP02GSV2Q.21.78.H01.1.454.CMB.2.raw
  modified_base (364)..(364): a, c, t, g, unknown or other
  modified_base (414)..(414): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagctgggtcccgccgaggcctccgaggggaacgggcctggagtggatctctactttatttatagtggtgtaccccanatactacacagactccggtgaacgggccgattccaccatcctacagaaanacaattacccaagaacactattagtatacttacaaatgaaataacctgagacgaccgaagaccacggccatgtatacgtgtcggtgggctactttacgtcggaccccgtcgggggcccgggtaaacctcgggtacctacccggtccctacccccgaccctacccgaaccgaacccggg

SEQ ID NO: 418760 - DNA, 617 bp, Homo sapiens
  misc_feature: GZ8MTXP02GJZOR.21.78.H01.1.454.CMB.2.raw
  modified_base (416)..(416): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttatttatagtggtggtacccacatactacacacgactccgtgaacgggccgattcacatctcagaagacaatcccaagaacnctaattgaatcttacaaatgaaataaccgtgagagccgaaggacacggccaatgtaacttacgtggtagtcgggggactaacgttttaacgtcggtaaacccccgggtgggggacccccgggggtaaaaccccgttcgggtcccgtaaaccccgttcccgtacccccccgtaacccttccccgaaccgtaaaccccggggg

SEQ ID NO: 418761 - DNA, 598 bp, Homo sapiens
  misc_feature: GZ8MTXP02ITVV1.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcagtggcgactacatgagctgggtccgccaggctccgagggaaggccgtggagtggatctctactttattatagtggtggtacccacatactacacagactcgtagaacgggccattcacatcacagaagacaattccaagaacactattgtaatcttacaaaattgaaactaacctgaacgagaccgagacacggcaagtgtaattactggttggtggggtctaattttaccgtacggtacccccgttggggggaccccgggtaaaccctgggtacccgtaacccggttccctacccccaccccgtaccaacccgaacccgggg

SEQ ID NO: 418762 - DNA, 563 bp, Homo sapiens
  misc_feature: GZ8MTXP02HJSLS.21.78.H01.1.454.CMB.2.raw
  modified_base (481)..(481): a, c, t, g, unknown or other
  modified_base (486)..(486): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggcctccgaggggaacggcctggagtggatcgtcactttattatagtggtgtaccccactatactacacagactccgtgaaagggccgattcaccatcctcagaagactaatccaagaacacattagtatcttacaaaatgaaatacctagagagaccgagacacggcatcgtatacngtagngggctacgttacgtcgacccgtgggggcccggtaaccgtcggtcacccggtcctaccccgaccctccacccgaccgg

SEQ ID NO: 418763 - DNA, 722 bp, Homo sapiens
  misc_feature: GZ8MTXP02ICBHL.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggagggaggcttgatccagccgtgggggtccctgagactctcctgtgcagtctcgtgggttcgtcgagtggcgactacatgagtcgtcggggtcccgccgagggcctacccggaaggggaacggggcccgtggggaggtgggacttccgtactactttatttaagtaggttgggtcggtaaccccactactaactacacacgaccttccggtagggaaacggggcccgtaattccacctattcctaccgaagaaacgacaaacttacccgaaaggaaacactattagtaacttaccttaacaaaattacgtaaactaaacccgtaggaagacggacccggaaggaccgaccggacctaagttgttaactttacgtggttgggtggggtacttaacgttttaccgtaccgggtacccccggtcggggggtacccccgggaacccgttcggggtaccctaaccccgggttcccctaccccccgtaccccgtacccgaaaccccggaaaccccgggg

SEQ ID NO: 418764 - DNA, 632 bp, Homo sapiens
  misc_feature: GZ8MTXP02IF7PH.21.78.H01.1.454.CMB.2.raw
  modified_base (379)..(379): a, c, t, g, unknown or other
  modified_base (388)..(388): a, c, t, g, unknown or other
  modified_base (423)..(423): a, c, t, g, unknown or other
  modified_base (460)..(460): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtcggcgactacatggagcgtcggggtcccgccgagggcctccggaaggggaacgggccgtgggagtgggactctctaactttatttataggtggtacggtaccccanatactacanagactcgtgaacggccgattccacatctacagaanacaactacaaggaacacattagtatacttacaaatanaaactaactgaagacggaccgaagacgacgacctatagtaattacgtggtacggtgggggtctaacgtttacgttccggtaccccggtcgggggtaccccggggtaaacccgtcgggtacccgacccggttccccacccccgtaccccttaccccgaacccgaaaccccggg

SEQ ID NO: 418765 - DNA, 594 bp, Homo sapiens
  misc_feature: GZ8MTXP02F6M71.21.78.H01.1.454.CMB.2.raw
  modified_base (473)..(473): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctggggtcccgccaggctccgaggggaagggcctggagtggatctcactttatttatagtggtggtaccccacatactacacagactccgtgaacggggccattccacatctcaagaagacaattccaagaacacattagtatacttacaaatgaaataacctgagagaccgagacacggccatntattacgtgtggtggggctacgtttacgttcggtaccccggtcgggggacccggggtaaacccgtgggtacccgacccgttcccgtacccccctaccccgtcccgaacccgaaacccgggg

SEQ ID NO: 418766 - DNA, 632 bp, Homo sapiens
  misc_feature: GZ8MTXP02I1H81.21.78.H01.1.454.CMB.2.raw
  modified_base (456)..(456): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggtcttgatccagccgtgggggtccctgagactctcctgtgcagtctctgggttcgtcagtggcgactacatgagcgtgggtcccgccgaggctccgagggaagggcctggaggtggacttctcgtactttagtttagtaggtggtaggtacccccactagtactacacgacgacctccgggtagaaacgggggccagttccaccattctacgaagaaagactaaacttcccgaaggaaacnctaattgtatctaataaatagaaactaccgtgagacgaccgaagacgacggcaatgtattactggtggtggggtacctatttacgtcggtaccccggtagggggacccggggaacccttgggtcccgtacccggttaccctcccccgaaccccgtccgaaaccccggtaacccggg

SEQ ID NO: 418767 - DNA, 589 bp, Homo sapiens
  misc_feature: GZ8MTXP02HT1EV.21.78.H01.1.454.CMB.2.raw
  modified_base (356)..(356): a, c, t, g, unknown or other
  modified_base (365)..(365): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgagggaacggcctggagtggatctcactttattatagtggtgtacccanatactacanagactccgtgaaggccgattcaccatctcaagaagacaattccaagaaacacgtattagtatacttacaaattagaaataacctagagacgaccgaagacacggcatagtatactgtgtaggggtactacgtttacgttacgaccccggttacgggggacccgggtaaccgtcggtacccgacccggtccctacccccgacccctaccgaacccgaaacccggg

SEQ ID NO: 418768 - DNA, 602 bp, Homo sapiens
  misc_feature: GZ8MTXP02HAXXS.21.78.H01.1.454.CMB.2.raw
  modified_base (357)..(357): a, c, t, g, unknown or other
  modified_base (396)..(396): a, c, t, g, unknown or other
  modified_base (398)..(398): a, c, t, g, unknown or other
  modified_base (433)..(433): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtccgccaggctccgaggggaaggcctggagtggatctctacttattatagtggtgtaccccanatactacacagactccgtagaagggccattcaccatcananaagacaattcccaaggaacacattgtataccttanaaaatgaaactaaccgtgagacggccgaaggacacggaccagtcgtaattacgtagtggtaggggatacgtttacgtcggaccccggttcgggggaccccgggtaaacccgttgggtaccctacccggttcctacccccgaccccgtacccgaaacccgtaacccgggg

SEQ ID NO: 418769 - DNA, 623 bp, Homo sapiens
  misc_feature: GZ8MTXP02GUS28.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcgagtggcgactacatgagcgtgggtcccgccaggctccgaggggaaggcctggagtggatctcacttattatagtggtgtacccacatacacacagactccgtgaacgggccgattcaccatcctacagtaaagacaacttcccaaggaaacacatttacgtaatacttacaaaatgaaaattaacctagaacgaggcccgaaaggaccgacggacctaatagtaactttacgtggtggtcgggggacttacgtttaccgttacggtaccccggtcgggggaccccggggtaaacccgtcgggttcccacccggttccctacccccggaccctaccccaccgtaaaccccggg

SEQ ID NO: 418770 - DNA, 642 bp, Homo sapiens
  misc_feature: GZ8MTXP02F8INL.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccaggctccgagggacggcctggagtggatctctactttattagtagtggtcgtaccccactatactacacacgactccgtagaacgggccgtatccacatctacaagaaacgactaaacttcccaaggaaacactattagtaactacttacaaaattagaaactaacccgtagaacgaacggaccgaaacggaccaccggacctaagtagttacttaacgtggtaggtacggggtacttaacgtttacgttacggtaccccggtacgggggccccgggtaaacccgtcggtacccgaacccgttcccgtacccccaaccctacccgaacccgtaaacccggg

SEQ ID NO: 418771 - DNA, 774 bp, Homo sapiens
  misc_feature: GZ8MTXP02GE61V.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgaggtggcgactacagtgagtcgtcgggtccgccgaggcctaccggaggggaacgggtcccgtagggaggtgggacttccgttactacttttaatttagtaggttgggtacggtaaccccactaatactaacacacgacgtccggtaggaacggggtccgtacttaccgactagtcctacgaaagaaacgaactaaacttaccgaaaggtaaaccacttaacgtttacgtaattaccttaaactaaaagttacgtaaaacgttaacccgttagggaacggaaccggacccggaaacgggaacccgaacccggggtaccctaaagttacggttaaacgtttaaccgttgggttacggggtacgggggtaacctttaaccggtttttaccggtacccgggtacccccggggtaccggggggtaaccccggtaaacccggttcggtaccccgtaacccggttccccctacccccgtaccccgtaccccgacccggtaaaccccggg

SEQ ID NO: 418772 - DNA, 583 bp, Homo sapiens
  misc_feature: GZ8MTXP02GAE6D.21.78.H01.1.454.CMB.2.raw
  modified_base (343)..(343): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctggggttcgtcagtggcgactacatgagctgggtcccgccaggctccgaggggaaggcctggagtggatctcactttatttanagtggtggtaccccacatactacacagactccgtgaaagggccgaattcaccatctcagaacgacaaattcccaaggaaacactaattgtatacttacaaaattagaaataaccctgaagagaccgaaggacaacgggcctaatgtattacgtgtggtggggctatttactcggtacccctagggggcccgggtaaccctggtaccaaccggtcctcccccacctaccaccgaaaccggg

SEQ ID NO: 418773 - DNA, 639 bp, Homo sapiens
  misc_feature: GZ8MTXP02JA8OB.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttctcagtggcgactacatgagcgtgggtccgccaggctcgagggacggctggagtggatctctactttatttagtaggtggtacggtaccccactactactacacagacctccggtagaaacggggcctagttccaaccatctacgagaaacgactaacttacccaagaacactaattagtacttacttaacaaatacgtaaataacctagagacgaccgaggaccgacggacctaatgtatacgtggtcggtaggggtactacgtttacgttccggacccggtacgggggcccggggtaaacccgttcgggtacccgtacccggttcccctacccccgtaccccgtaccccgtaacccggtaaccccggg

SEQ ID NO: 418774 - DNA, 573 bp, Homo sapiens
  misc_feature: GZ8MTXP02IDC45.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctccgagggacggcctggagtggatctctacttattatagtggtggtaccccactatactacacagactccgtgaacggccgattcaccatctacagagacattaccagaacactattagtatcttacaaattgaaactaaacctgaagagaccgaggaacacggccatgtatacgtgtaggtggggctactttacgtcgtacccgtcgggggacccgggtaacccgtcggtccaccggtcctcccccgacccctaccgacccgaacccggg

SEQ ID NO: 418775 - DNA, 580 bp, Homo sapiens
  misc_feature: GZ8MTXP02GJIFV.21.78.H01.1.454.CMB.2.raw
  modified_base (298)..(298): a, c, t, g, unknown or other
  modified_base (358)..(358): a, c, t, g, unknown or other
  modified_base (468)..(468): a, c, t, g, unknown or other
  modified_base (475)..(475): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccnccgaggctccgagggaggcctggagtggatctcactttatttagtagtggtgtaccccanatactacacagactccgtgaacgggccgattcacatctacagaagacaattccaaggaacactattgtatctacaaaatgaaataactagagagaccgagacacggcatntagtacnggtgtggggctacgtttacgtacggtaccccgtacgggggacccggggtaacccgtcgggtacctacccgtcccgtacccccaccctacccaacccgaacccggg

SEQ ID NO: 418776 - DNA, 596 bp, Homo sapiens
  misc_feature: GZ8MTXP02H6FO9.21.78.H01.1.454.CMB.2.raw
  modified_base (299)..(299): a, c, t, g, unknown or other
  modified_base (358)..(358): a, c, t, g, unknown or other
  modified_base (427)..(427): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccnccgaggctcgagggaggcctggagtggatctctacttattagtagtggtagtaccccanatactacacagactcgagaacgggcctattccacatcacagaagacaactaccgaagaaacacgtattnacttctacaaaatgaaactaacgtgaacgagaccgaagaccgacggcaattcgtattacgtgtaggtgggtactatttacggtcgtacccggtacgggggtacccgggaacccgtcggtcccgtaacccgtccctacccccaccccgttaccgaaccccgtaacccggg

SEQ ID NO: 418777 - DNA, 571 bp, Homo sapiens
  misc_feature: GZ8MTXP02IACXO.21.78.H01.1.454.CMB.2.raw
  modified_base (360)..(360): a, c, t, g, unknown or other
  modified_base (488)..(488): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggcctccgagggaaggggcctggagtggatctctacttattatagtggtggtaccccanatactacacagacctccgtagaaggccgattccaccatctacagaagacaattaccagaacacattgtatcttacaaaatgaaataactagagagaccgaggacacggccatacgtattacgtgtagnggggtcaatttactcgaccccgtcggggacccggggaaccctgggtccacccgtcacccccgtaccctcccaaccgaaccggg

SEQ ID NO: 418778 - DNA, 703 bp, Homo sapiens
  misc_feature: GZ8MTXP02IBVS6.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggagggaggtcttggatccgacggtccggtcgggggtcctgacgtactctccgtgtgctagtctcgttcgggttcgtcgaggtggcgactacatggacgcgtcgggtccgccgaggccgtaccggagggacgggccgtgggagtggatctactacttattagtaggtggtcgtacccactatactacacagtactccgtaggaacggccgtattaccactatctacaagaacacaacttacgaacgaactactattagtaattactaactaaatacgtaaactaacgtagaacgacgaccgaacggaaccgacgggtacctaagttagttaacgtttacgtaggttaggggtacggggtactttaacgttttacccggtaccggttaccccggggtaccggggggtaccccggggtaaccccggtcgggtacccccgtacccggttacccctaccccccggtaacccccgtaccgaaccccggtaaaccccggg

SEQ ID NO: 418779 - DNA, 711 bp, Homo sapiens
  misc_feature: GZ8MTXP02GXZRV.21.78.H01.1.454.CMB.2.raw
  modified_base (365)..(365): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtgggtcccgccgaggctccgaggggacgggccgtggagtggatctctactttattagtagtggtgtaccccanatactacacagactccgtagaacgggccgattccaacatcctacagaaagaacaaacttaccaaggaaaccaacgtattagtaacttacttaactaaaatcgtaaaacttaacccgtaggaacgaacgggaccggaaacgggaacccgaaccggggaccctaaagttaccgttaagtttaaccgtagggtttacgggtacgggggtacttaaacgtttttaccgttaccgggtaacccccgggttaccggggggtacccccggggtaaaccccggttcgggttacccgtaccccggttacccctaccccccgtaaccccgtaccccgaacccgtaaacccccgggg

SEQ ID NO: 418780 - DNA, 621 bp, Homo sapiens
  misc_feature: GZ8MTXP02JAI3Q.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatggagcgtgggtccgccaggcctccgaggggacggcctggagtggatctcacttatttatagtggtcgtacccacatactacacagactcgtagaaggccgattcaccatcctacgagaacgacaattaccaaggaaaccactattagtaatacttactaaatagtaaataacctagagacgaccgaagacgacggcctagtagtattaacgtgtaggtcggggacttacgtttaacgttcggtaccccggtacgggggaccccggggttaaacccgtcgggtacccgtaacccggttccctacccccgtaccccttacccgaacccgaacccgggg

SEQ ID NO: 418781 - DNA, 587 bp, Homo sapiens
  misc_feature: GZ8MTXP02JE82F.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtccgccaggctccgaggggaacggcctggagtggatctcactttattataggtggtagtacccacatactacacagactccgtgaaaggccgatcaccatctacagaacgacaattcccgaagaaacacgatttagtaacttcttacaaaatgaaataacctgagagacccgaagaccacggacatagtattacgtgtacggtgggactagtttacctacggaccccgtcgggggcccgggtaaccgtcggtcccgtaaccggtcctacccccacctacccacgtaacccgg

SEQ ID NO: 418782 - DNA, 585 bp, Homo sapiens
  misc_feature: GZ8MTXP02JYBCL.21.78.H01.1.454.CMB.2.raw
  modified_base (388)..(388): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctggggttttccttgttgctattttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaagggcctggagtggatctcacttatttatagtggtggtaccccacatactacacagactccgtgaaggggccgnttcaccatctcagaagacaattccagaacacattagtatcttacaaatgaaataacctgagaggacccgaggacgaccggacactggtattacgtagtggtggggctatttaccgttcgacccccgtcgggggcccggggaaacccttggggtcctaacccggtcctcccccgacccttacccgacctaacccgggg

SEQ ID NO: 418783 - DNA, 612 bp, Homo sapiens
  misc_feature: GZ8MTXP02GE1CW.21.78.H01.1.454.CMB.2.raw
  modified_base (300)..(300): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccnccgaggctccgaggggaacggcctggagtggatctctactttatttatagtggtacggtaccccactatactacacacgactccatggaaacgggccgaattcaaccatccgtacaaaggaaacgaacaaacttcccgaaaggaaccaactatttagtaactcttaacaaatagtaaactaaccgagtaacgagaccgaaggacacggcagtagtatacgtagtggtaggggcttaagtttcgtcgacccggtcgggggacccggtaaccgtcgggtaccaccggtccctaccccgaccctaccaaccccgg

SEQ ID NO: 418784 - DNA, 558 bp, Homo sapiens
  misc_feature: GZ8MTXP02IK3NN.21.78.H01.1.454.CMB.2.raw
  modified_base (361)..(361): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggtttgtcagtggcgactacatgagctgggtccgccaggctccgaggggaagggcctgggagtggatcgtctacttatttatagtggtggtaccccanatactacacagactccgtgaacgggccgattccacatctacagaaagacaattccaaggaacactattgtatctacaaaatgaaataacctgagagaccgaggacacggcatgtatacgtgtggtgggctagtttactcgacccgtcgggggcccggaacctggtccaccgtccgtccccaccctccaaccgaccgg

SEQ ID NO: 418785 - DNA, 572 bp, Homo sapiens
  misc_feature: GZ8MTXP02JX3F6.21.78.H01.1.454.CMB.2.raw
  modified_base (445)..(445): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtccagtggcgactacatgagctgggtccgccgaggctccgaggggaagggccctgggagtgggatctcgtactttaatttataggtgggtggtaccccacatactacacagactccgtgaagggccgattccaccatctcagaaagacaattccaaggaacacattgtatcttanaaatgaaatacctgagagcgagacacggccatgtattactgtaggtggggctatttacgttcgacccgtcgggggacccgggaaccgtcggtaccaccgtcctcccccacctcccaccgaacccggg

SEQ ID NO: 418786 - DNA, 563 bp, Homo sapiens
  misc_feature: GZ8MTXP02JRB07.21.78.H01.1.454.CMB.2.raw
  modified_base (355)..(355): a, c, t, g, unknown or other
  modified_base (488)..(488): a, c, t, g, unknown or other
  modified_base (529)..(529): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaaggcctggagtggatctcacttatttatagtggtgtacccanatactacacagactccgtagaaagggccgattcgacccatcctcaagaaagacaattaccaggaaacacaattgtacttcttacaaatagaaactaaccgtgaagcgacgaggaccacggccagtgtattacngtgtgggctagttacttcgacccgtcggggccggtaaccgngtcctaccgcctccccgaccctccgaccaaccgg

SEQ ID NO: 418787 - DNA, 576 bp, Homo sapiens
  misc_feature: GZ8MTXP02GROIE.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggattcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtccgccaggctccgaggggaaggcctggagtggatctcacttattatagtggtgtaccccacatactacacagactccgtgaacggccgattccacatctacagaaagacaattccaagaacacattgtatcttacaaatgaaataacctgagacgaccgagacacggccagtgtatacgtgtggtggggctagtttacctcggtaccccgtgggggaccccggggtaaccgtggtacccgaccggtccctacccccgacccgtacccgaacccgtaacccggg

SEQ ID NO: 418788 - DNA, 562 bp, Homo sapiens
  misc_feature: GZ8MTXP02HGSI7.21.78.H01.1.454.CMB.2.raw
  modified_base (358)..(358): a, c, t, g, unknown or other
  modified_base (393)..(393): a, c, t, g, unknown or other
  modified_base (397)..(397): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgttgggttcgtcagtggcgactacatgagctgggtccgccaggctcgagggaggcctggagtggatctctactttatttatagtggtggtaccccanatactacacagactcgtgaacgggccatcacatcnaganacaatcagacacattgtatacttacaaaatgtaaactacgtagagacgaccgaggacacggacagtgtatacgtcgtggtcgggacttattacgtcgacccgtcgggggacccggtaaccctggtacccgacccgtcctacccccgacctacccgaccgaaccgg

SEQ ID NO: 418789 - DNA, 612 bp, Homo sapiens
  misc_feature: GZ8MTXP02IDA5I.21.78.H01.1.454.CMB.2.raw
  modified_base (490)..(490): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaggcctggagtggatctcactttatttatagtggtggtaccccacgatactacacagactccgtgaagggccgattccacgatctacagaagaacaattcccaaggtaaacacatttagtatcttacgaaaatgaaatacctgaagcgaccgaggacacggacatgttaacttacgngttaggtggggacctagttttaaccgtcggtaaccccggtcgggggaccccggggtaaacccgtcggggtccctaaccccggttccctacccccgtaccccgtcccgaacccgaacccgggg

SEQ ID NO: 418790 - DNA, 602 bp, Homo sapiens
  misc_feature: GZ8MTXP02FUFXQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtggggggtccctgagactctcctgtgcagtctcgtgggttcgtcagtggcgactacatgagctggggtccgccaggcctccgagggaagggcctggagtggatctctactttatttagtagtggtaggtaccccacatactacaacagactccgtagaacggggccattccacatcctacaagaagaacaattacccaaggaaacactattagtattactacaaatacgaaataacctgagagaccgaggacacggaccaatcgtattacgtgtggtggggctactttacgtcggaccccgtcgggggcccgggtaaacccggtcggtaccgacccggttccctacccccgaccctcccgaacccgaacccggg

SEQ ID NO: 418791 - DNA, 579 bp, Homo sapiens
  misc_feature: GZ8MTXP02GD6AI.21.78.H01.1.454.CMB.2.raw
  modified_base (494)..(494): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgcaggctccgagggaaggcctggagtggatctcactttattatagtggtggtaccccacatactacacagactccgtagaacggggccatttaccgacccaatcctacaagaaagacaaattcccgaagaaacacgtattgtatcttacaaaatgaaactaacctgagacggccgaaggacacggccagtgtattacngtggtggggctatttactcgaccccgtcgggggcccggtaaccgtggtccacccggtcctacccccaccgtcccaccgtaaccgg

SEQ ID NO: 418792 - DNA, 604 bp, Homo sapiens
  misc_feature: GZ8MTXP02IRE29.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccgtgggggtccctgagactctcctgtgcagtctctgggttcgtcagtggcgactacatgagcgtgggtcccgccgaggcctccgaaggggaacgggcccgtgggaggtggactccgtctactttatttataggtggtcggtaccccacatactacacagactccgtagaacgggccgattccacatctcagaagacaatccaagaacacattgtatcttacaaatgaataacctgagagaccgagacacggctagtgtatacgtgtagtggggactacgtttacgttcgaccccggtacgggggaccccggggtaacccgtcggtacccgtacccggtccccgtacccccgacccccgtcccgaacccgaacccgggg

SEQ ID NO: 418793 - DNA, 562 bp, Homo sapiens
  misc_feature: GZ8MTXP02FKGNW.21.78.H01.1.454.CMB.2.raw
  modified_base (475)..(475): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaaggcctggagtggatctcactttatttatagtggtggtaccccacatactacacagactccgtagaacgggccgattcacatctcagaagacaatccaaggaacacattgtatacttacaaaatgaaataacctgagagccgaggacacggcatgtatacngtcgtgggctagttacttcggaccccgtcgggggcccgggtaaccctggtcctacccggtcctacccccaccctccaccgaaccggg

SEQ ID NO: 418794 - DNA, 674 bp, Homo sapiens
  misc_feature: GZ8MTXP02HBL3R.21.78.H01.1.454.CMB.2.raw
tcagtcgtcgctcgcacgaccggtgctcgattagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgagggcctccggaggggaacgggccgtagggagtggatctctactttattagtagtggtggtacccacatactacacagactccggtagaacggggccgtattccgaaccatacctacgaagaaacgaactaaacttacccgaaaggaacctaactaatttacgtacttactactaaaatcgtaaactaaccgtagaacggacggacccggaaggaaccgacgggaccaagttacgttaacttacgtaggttaggtcgggggtacttaacgtttaccgtaccggtaccccgggtcgggggacccggggtaaccccgtcgggtcccacccggttccctaccccccgtacccgtaccccgaaccgtaaccccggg

SEQ ID NO: 418795 - DNA, 575 bp, Homo sapiens
  misc_feature: GZ8MTXP02JBQRS.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctcacttatttatagtggtggtaccccacatactacacagactccgtgaacgggccgattccacatctacagaagacaattccaaggaacacattgtatcttacaaatgaaataactgaagacgacgaagacacggccatgtatacgtgtggtggggactagtttactcggaccccgttggggggcccggtaaacccgtggtacccgacccggttcctaccccccacccgtacccgaccgaacccggg

SEQ ID NO: 418796 - DNA, 637 bp, Homo sapiens
  misc_feature: GZ8MTXP02F3H6A.21.78.H01.1.454.CMB.2.raw
  modified_base (500)..(500): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtccgccgaggcctccgaaggggaacggccgtggagtggatctactactttatttataggtggtaggtaccccacataactacacagactccgtagaacgggccgacttccaacctatctacaagaaacgaactaaacttacctaagaaacaactaattagtacttacttaactaaaattaagaaactaaaccgggggggtanaaggacgacgaacgacgacgacatagtatacgtgtggtcggtacgtacgtttacgttaccggtacccggtaccgggggacccggggtaccgtccggtccgacccgtcccctaccccacccctacccgacccgaaccg

SEQ ID NO: 418797 - DNA, 593 bp, Homo sapiens
  misc_feature: GZ8MTXP02JRW56.21.78.H01.1.454.CMB.2.raw
  modified_base (365)..(365): a, c, t, g, unknown or other
  modified_base (489)..(489): a, c, t, g, unknown or other
  modified_base (494)..(494): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtggggtccgccgaggcctccgaggggaacgggcctgggaggtggatctctacttattatagtggtgtaccccanatactacacagctccgtgaagggccgatcgaccatctcagaaacgacaattcccgaagaacactattgtactcttacaaaatgaaataacctgagacgaccgagaccacggcatcgtattacgngtggnggggtctagtttacctcggaccccgtcgggggacccgggtaacccgtcggtaccctacccggtcccgtacccccaccccgtaccgaacccgaacccggg

SEQ ID NO: 418798 - DNA, 585 bp, Homo sapiens
  misc_feature: GZ8MTXP02GTZI2.21.78.H01.1.454.CMB.2.raw
  modified_base (299)..(299): a, c, t, g, unknown or other
  modified_base (494)..(494): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagctggggtcccnccgaggcctccgaggggaaggcctggagtggatcgtcactttatttagtaggtggtagtaccccacatactacacagactccgtagaacggggcattcaccatctacagaagacaacttcaagaacacattagtatacttacaaatagaaactactagagagccgagaccacggcaatgtatacgtgtagtgggntacgtttactacgtaccccggtcgggggaccgggtaacccgtcggtacccgtaccggtccctacccccgacccgtacccaccggaacccgg

SEQ ID NO: 418799 - DNA, 617 bp, Homo sapiens
  misc_feature: GZ8MTXP02FNVTN.21.78.H01.1.454.CMB.2.raw
  modified_base (341)..(341): a, c, t, g, unknown or other
  modified_base (355)..(355): a, c, t, g, unknown or other
  modified_base (373)..(373): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggccgtggagtggatctcacttattanagtggtgtacccanatactacacagactccgngaagggccgattccacatctacagaaagacaattaccaaggaaacactaattagtaatcttacaaaatgaaataacctagagagaccgaaggacacggccaagtgtaattactggtggtaggggacttaacgtttaaccgttcggtaacccccggtcgggggtaccccggggtaaaacccgttcgggtacccgtacccggtaccctaccccccgaaccccttacccgaacccgtaaacccgggg

SEQ ID NO: 418800 - DNA, 587 bp, Homo sapiens
  misc_feature: GZ8MTXP02G870D.21.78.H01.1.454.CMB.2.raw
  modified_base (495)..(495): a, c, t, g, unknown or other
  modified_base (500)..(500): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgagggaagggcctggagtggatctcactttattatagtggtggtaccccatatactacacagactccgtagaacggggccgtattccaaccgatcctacaagaaacgacaaattcccaaggaacacattgtaatcttacaaaatgtaaataacctgaagagacccgaggaccacggccatgtatacgngtcgngggactacgttacgtcgacccgtcgggggacccgggaacctcggtaccgtacccgtcctacccccgaccctcccaaccgtaacccgg

SEQ ID NO: 418801 - DNA, 640 bp, Homo sapiens
  misc_feature: GZ8MTXP02I92H7.21.78.H01.1.454.CMB.2.raw
  modified_base (415)..(415): a, c, t, g, unknown or other
  modified_base (431)..(431): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtcccgccgaggctcccgaaggggaacgggcctgggagtggactctctaactttatttataggtggtacgtaccccacatactacacagactcgtagaacgggccatcacatctacagaanacaattccaagaaacncaattagtacttacttaacaaaatagaaactaacctagaagacggaccgaaacggacacggacctaagttcgtaattacgtgttagggtggggacttaacgtttacgtaccggtacccccggtcgggggacccccggggaaacccgttcgggtcccgaacccggttccccgtacccccctaccccgtacccgaacccgtaaacccgggg

SEQ ID NO: 418802 - DNA, 771 bp, Homo sapiens
  misc_feature: GZ8MTXP02JT9OZ.21.78.H01.1.454.CMB.2.raw
  modified_base (533)..(533): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgatccgaggccgtcgggggtccctgagactctcctgtgcagtctcgtgggttcgtcgaggtggcgactacagtggagcgtcgggtcccgccgaggcctaccggaggggaacgggccgtggaggtggactctctactttatttataggtggtcgtacccactatactacacgacgtacgtccggtaggaaacgggcccgtacttaccgaacctacttacctacgaaaggaaacacctaaacgttacccgaaaggaaacctactaagttttacgaactttccttaaactaaaaacttggtaaaacctttaacccgngaacggaccgggacccgaaaggaccgaccgggacctaagttaggttaacttaccgtaggttaggggttacgggggttaccttaaacggtttttaacccgtacccggggtaaccccccgggggttacggggggtacccccgggggtaaacccgttccgggggtaaccccctaacccccggttcccccgtaacccccccgtaacccccggtacccccggaacccggtaaacccccggggg

SEQ ID NO: 418803 - DNA, 563 bp, Homo sapiens
  misc_feature: GZ8MTXP02FULZ6.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaggcctggagtggatctcacttattatagtggtggtaccccacatactacacagactccgtgaagggccgattcacatctcagaagacaattccaagaacacattgtatacttacaaaatgaaataacctagagagacgaggacacggccatgtatacgtgtggtggggctagtttactgaccccgtcgggggacccgggtaacccgtcgggttccacccggtcctcccccacccgtaccacccgtaaccggg

SEQ ID NO: 418804 - DNA, 691 bp, Homo sapiens
  misc_feature: GZ8MTXP02HKHAT.21.78.H01.1.454.CMB.2.raw
  modified_base (313)..(313): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgcttatttacaaaaggtgtccagtgtgaggtgcagttggtggagacgtgggaggaggcttgatccaggccgtcgggggtcctgacgactctcctgtgctagtctcgtgggttcgtcgaggtggcgactacgatggagcgtggggtcccnccgaggcctccggaaggggaacggccgtagggagtggactcgtactaactttattagtaggtggtacggtaccccatatactaacacagtactccggaggaacggcgtatccacatccgacaagaagcaaacttccaaagaaactctagttatacttactaacaaatagtaaactaccgtagaagtacgaccgaaggaccgaacggcctagttagttacgttaacgtcggttaggtacggggtacttaaacgtttaccggttaccggacccccggggttacggggggacccccggttaaacccgttcgggggtaacccctcccgggttaccccctaccccccgtaaccccgtccccgtaaaacccgggtaaccccggg

SEQ ID NO: 418805 - DNA, 535 bp, Homo sapiens
  misc_feature: GZ8MTXP02IXSQ6.21.78.H01.1.454.CMB.2.raw
  modified_base (338)..(338): a, c, t, g, unknown or other
  modified_base (351)..(351): a, c, t, g, unknown or other
  modified_base (361)..(361): a, c, t, g, unknown or other
  modified_base (391)..(391): a, c, t, g, unknown or other
  modified_base (393)..(393): a, c, t, g, unknown or other
  modified_base (396)..(396): a, c, t, g, unknown or other
  modified_base (398)..(398): a, c, t, g, unknown or other
  modified_base (408)..(408): a, c, t, g, unknown or other
  modified_base (421)..(421): a, c, t, g, unknown or other
  modified_base (427)..(427): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctctgtgcagtctctggttcatcagtggcgactacatgagcgtggccgccaggctccgaggggaaggcctggagtggatctcacttattanagtgtcgtaccanactactacanagactccgtagacgggcctatcacatctananaananactacagaanatatatatactanaaatanaataactagagagacgacgacgacgacatatatatgtgtggtacgtacttacgtacgaccggtcgggacggtaaccgtcgtaccgtacctcctccctacccaccaccg

SEQ ID NO: 418806 - DNA, 614 bp, Homo sapiens
  misc_feature: GZ8MTXP02H58A6.21.78.H01.1.454.CMB.2.raw
  modified_base (410)..(410): a, c, t, g, unknown or other
  modified_base (417)..(417): a, c, t, g, unknown or other
  modified_base (512)..(512): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtgagacgtggaggaggcttgatccagccgtgggggtcctgagactctcctgtgcagtctcgttgggttcgtcgaggtggcgactacatgagcgtcgggtccgccgaggcctccgaggggacggccgtaggagtggatctactactttattagtaggtggtacgtaccccactatacacacacgactcgaggaacggcctattccacatcncgaaganactaataccaagaacactattagtacttcttaacaaattacgtaaactaaaccgttgacgacgaccggagaaccgacggacagttcgtaattcgnggttcggacgggtctatttaccgtcggtaccccggtcgggggcccggtaacccgtcggtacccacccggttcccacccccgacctacccgacccgaaccggg

SEQ ID NO: 418807 - DNA, 575 bp, Homo sapiens
  misc_feature: GZ8MTXP02J1P8J.21.78.H01.1.454.CMB.2.raw
  modified_base (483)..(483): a, c, t, g, unknown or other
  modified_base (487)..(487): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctctgggttcgtcagtggcgactacatgagctgggtccgccaggctccgaggggaacgggcctggagtggatctcacttatttatagtggtggtaccccacatactacacagactccgtgaacgggccattccacatctcagaagacaaattcccaaggaacacattagtatcttacaaaatgaaataacctgaagacgaccgagacgacggccatgtattacngtgngggctagtttacgtcgaccccgtcgggggacccgggtaaccctgggtcccacccggtcctcccccgaccctacccgaccgaacccggg

SEQ ID NO: 418808 - DNA, 638 bp, Homo sapiens
  misc_feature: GZ8MTXP02GK573.21.78.H01.1.454.CMB.2.raw
  modified_base (297)..(297): a, c, t, g, unknown or other
  modified_base (343)..(343): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccnccgaggctccgaggggaaggcctggagtggatctcactttatttanagtggtggtaccccacatactacacagactccggtagaaacggggccgattccaaccatcctcaagaaagacaaattacccaagaaacactattagtatacttacaaaatagaaataacctgaagacgaccgaaggacacggcctagtgtaattacgtggtggtcggggtactaacgttttaccgtcggacccccggttcgggggacccccggggtaaaccccgttgggtaccccgtaccccggttacccctaccccccaacccccgttaccccgaaccccggtaaaccccgggg

SEQ ID NO: 418809 - DNA, 582 bp, Homo sapiens
  misc_feature: GZ8MTXP02JDHS1.21.78.H01.1.454.CMB.2.raw
  modified_base (302)..(302): a, c, t, g, unknown or other
  modified_base (379)..(379): a, c, t, g, unknown or other
  modified_base (385)..(385): a, c, t, g, unknown or other
  modified_base (403)..(403): a, c, t, g, unknown or other
  modified_base (405)..(405): a, c, t, g, unknown or other
  modified_base (427)..(427): a, c, t, g, unknown or other
  modified_base (440)..(440): a, c, t, g, unknown or other
  modified_base (479)..(479): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctggagactctcctgtgcagtctcgtgggttcgtcaggtggcgacgtacagtgagcgtgggtccnccgaggcctccgagggaacggcctggagtggatctgtacttagtttatagtggtcggtaccccactatactacacanactcgngaacggcgatcacatcananaagacatccaagacacagttanatctacaaagtanaaatacgtgaagcgacgacgacacggcaatacgtatacnggtacggtgggacctagtttacgtcggaccccgtagggggaccccggtaaccctgggtacccgaacccgtcctaccccccacccgtaccgaccggaaacccgg

SEQ ID NO: 418810 - DNA, 626 bp, Homo sapiens
  misc_feature: GZ8MTXP02JBKKO.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcggggtccgccgaggcctccgaaggggaacggggcccgtgggaggtgggatctctactttatttataggtggtggtaccccacatactacacagactccgtagaacgggccgattcaccatctacagaagacaattccaagaacacgtattgtatctacaaatgaaactaacctgagacgaccgaaggacacggacagtgttaattacgtggtacggtggggtactaacgtttactacggtacccccgtacgggggaccccgggtaaaccccgtcgggtcccgtaaccccggttcccctacccccgtaccccgtccccaacccggaaaccccggg

SEQ ID NO: 418811 - DNA, 584 bp, Homo sapiens
  misc_feature: GZ8MTXP02I0ZUF.21.78.H01.1.454.CMB.2.raw
  modified_base (331)..(331): a, c, t, g, unknown or other
  modified_base (357)..(357): a, c, t, g, unknown or other
  modified_base (424)..(424): a, c, t, g, unknown or other
  modified_base (432)..(432): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccagggctccaggggaaggcctggagtggatctnacttatttatagtggtggtaccccanatactacacagactccgtgaaggggccattccaccatctcagaagacaaattccaagaacacaattntatactanaaatagaaactaactagagacgaccgagacgacgacatagtatacgtgtcggtgggtacttacgtttacgtacggtaccccggtcgggggacccggggtaacccgtcggtacccgacccgtccctacccccgaccctacccgaaccgaacgg

SEQ ID NO: 418812 - DNA, 581 bp, Homo sapiens
  misc_feature: GZ8MTXP02IJBTU.21.78.H01.1.454.CMB.2.raw
  modified_base (357)..(357): a, c, t, g, unknown or other
  modified_base (400)..(400): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctccgaggggaggccgtggagtggatctcacttatttatagtggtcgtacccanatactacacagactcggtagaacgggccgtattccacatctanagaagacaacttcgaagacactattagtatacttacaaatagtaaataacctagagacgaccgaggacacggactagtgtactacgtgtggtgggtactacgtttacgtcgtacccgtacgggggtcccggaaccgtcggtcccacccgtccctaccccgaccctaccgaaccgtacccgg

SEQ ID NO: 418813 - DNA, 601 bp, Homo sapiens
  misc_feature: GZ8MTXP02HTPZU.21.78.H01.1.454.CMB.2.raw
  modified_base (358)..(358): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctccgaggggaacggcctggagtggatcgtctacttattatagtggtggtaccccanatactacacacgactccgtaggaaacgggcccgattccaccgtatcctacaagaaacgactaaattcccgaaggaaacactattgtacttcttacaaatgaaactaacctagagacgaccgaggaccacggaccagtagtattacgtgtggtggggtctacgtttacgttcgaccccggtcgggggacccgggaacctcggtcctacccgtccctacccccaccctcccgaccgtaacccggg

SEQ ID NO: 418814 - DNA, 605 bp, Homo sapiens
  misc_feature: GZ8MTXP02GYDGA.21.78.H01.1.454.CMB.2.raw
  modified_base (299)..(299): a, c, t, g, unknown or other
  modified_base (325)..(325): a, c, t, g, unknown or other
  modified_base (526)..(526): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttggatccagcctggggggtccctgagactctcctgtgcagtctcgtgggttcgtcagtggcgactacatggagcgtcgggccnccgaggctcggagggacggccgtggngtggtatctactactttattagtaggtggtacgtacccactactactaacacacgactccggtaggacggggcctattccaactactctacgaagaaacgactaacttacgaagtaaccatagttatacttcttaataaaatcgtaaactacgtgaacggacggacgacgacgacgactagtcgtaatgtggtgggtaggnttacgttacgtccgtaccccggggtcgggggacccgtaaccgtcgtcccacccggtcctcccccaccaccacggacccg

SEQ ID NO: 418815 - DNA, 576 bp, Homo sapiens
  misc_feature: GZ8MTXP02GHZNA.21.78.H01.1.454.CMB.2.raw
  modified_base (478)..(478): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctggggtccgccaggctccgaggggaagggcctggagtggatctcactttatttatagtggtggtaccccacatactacacagactccgtgaacgggccgattccaccatctacagaaagacaattccaagaaacacattgtatcttacaaatgaaatactagagagccgaagacacggccagtgtattacngtggtggggactactttacgtacgaccccgtcgggggacccgggtaaccgtcggtaccacccggtccctacccccgaccctcccaaccgtaacccggg

SEQ ID NO: 418816 - DNA, 656 bp, Homo sapiens
  misc_feature: GZ8MTXP02I6UAD.21.78.H01.1.454.CMB.2.raw
  modified_base (300)..(300): a, c, t, g, unknown or other
  modified_base (451)..(451): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcaggtggcgactacatgagctgggtccnccaggctccgagggaggcctggagtggatctcactttatttatagtggtaggtaccccacatactacacagactccggtagaacgggccgattccaaccatcctacagaaacgacaaacttccaaggaaacacagtttagtataccttaanaaaatagtaaactaaccgtagaacgacggaccgaaggaaccgaccggactaagttagttaacttacgtggttacgggtacgggtacttaacgtttaccggtaccgggtaccccggggtacgggggtacccccggggtaacccgttccgggtacccgtaccccgtcccctaccccccgtaccccgtaccccgaacccgtacccggg

SEQ ID NO: 418817 - DNA, 594 bp, Homo sapiens
  misc_feature: GZ8MTXP02ICAHR.21.78.H01.1.454.CMB.2.raw
  modified_base (255)..(255): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtcctgagactctcctgtgcngtctcgtgggttcgtcagtggcgactacatgagctgggtccgccgaggctccgaggggaagggccctggagtggatcgtctactttattatagtggtggtaccccacatactacacagactccgtagaagggcccgattccacatctcaagaagacattacccagaacacattagtattcttacaaaatgaaaactaacctgaagagaccgaggacacggccaagttcgtattacgtgtaggtggggtctacttttacgtcgtaccccgtcgggggtacccgggaacccgtcggtccacccggtccctaccccgtacccctcccgaaccgaacccgggg

SEQ ID NO: 418818 - DNA, 693 bp, Homo sapiens
  misc_feature: GZ8MTXP02H2IX7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccagccgtgggggtcctgagactctcctgtgctagtctcgttgggttcgtcgaggtggcgactacatgagcgtcgggtccgccgaggcctaccggaggggaacgggccgtagggaggtgggactctactatttatttaagtagtggtacgtaccccatatactacacagacctccgtaggaaacggccgtattccacctattccacaaagaaagaactaaacgttacccgaaaggaaactaactatttacgtaacttctttaacaaaattagtaaaacttaaaccgtagaagacggaccgaaggaaccgaccggccagtagttattaacgtggttaggtacggggtacttaacgtttaccgtaccggtaacccccgggtcgggggtaccccggggtaacccgttcgggtacccgtaaccccggttcccctaccccccgaccccgttaccccgaacccggaaaccccggg

SEQ ID NO: 418819 - DNA, 775 bp, Homo sapiens
  misc_feature: GZ8MTXP02JQI3O.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgaggtggcgactacatgagcgtggggtcccgccgaggcctccggaggggacggggccgtggagtggatctctactttatttataggtggtcggtaccccactatactacacagcctccggtagaacgggcctattccacctatcctacgaagaaacgactaacgttacccgaaaggaaaacctacctaagtttacgtaactttccttaaactaaaattcggtaaaacttaacccggtagggaaacgtaacgggaccccggaaagggaacccgtaacccggggtaccctaagttacggtttaaagtttacccggttgggttacgggggttacgggggttaccctttaaacgtttttaaaccgtccccggggttaacccccggggttccgggggggtaacccccggggttaaacccgttccgggggttaacccccgtaacccccggtttcccccgaccccccccgttaacccccgttaccccgtaaacccccgggtaaccccgggg

SEQ ID NO: 418820 - DNA, 601 bp, Homo sapiens
  misc_feature: GZ8MTXP02F2Y3U.21.78.H01.1.454.CMB.2.raw
  modified_base (447)..(447): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtgggtccgccgaggctccgagggacggcctggagtggatctcactttatttatagtggtgtacccacatactacacagactcgtgaacgggccgattccaccagtctacaagaaacgaactaaacttaccaagaaacacgtaattagtaatacttanaaaatagaaaactaacctagaagacgacgaacggacgacggacatcgtattacgtgtggtgggatacgtttacttacggacccgttacgggggcccgggtaaaccgtcggtacccgtaccgtccctacccccgaccctacccgaccgaacccgg

SEQ ID NO: 418821 - DNA, 561 bp, Homo sapiens
  misc_feature: GZ8MTXP02JLPLA.21.78.H01.1.454.CMB.2.raw
  modified_base (540)..(540): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaaggcctggagtggatctcactttattagtagtggtgtaccccacatactacacagactccgtgaacggccgattcaccatctacagaacgacaattccgaaggaaacactattagtatacttacaaatgaaatacctgagagccgaggacacggccatgtatctagtggtgggtcacgtttacgtcgacccgtcggggacccgggtacctggtccgacccgttccnccccgaccctccgaccaccgg

SEQ ID NO: 418822 - DNA, 603 bp, Homo sapiens
  misc_feature: GZ8MTXP02HAL61.21.78.H01.1.454.CMB.2.raw
  modified_base (260)..(260): a, c, t, g, unknown or other
  modified_base (503)..(503): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccaggccgtgggggtccctggagactctcctgtgcngtctcgtgggttctcagtggcgactacatgagcgtgggtccgcgaggctccgaggggaacggcctggagtggatctacgactttatttagtagtggtcgtaccccatactacgtacacgagtactccggtagaaacgggccgattccaaccatctacaagaaagacaattaccaaggaaacacattagtatactacaaaatgaaactaacctagagagaccgaagacacggcatgtaatacgnggtcgagggtactacgttacgtcggtacccgtcgggggacccggtaaccgtggacctacccggtcccacccccgtaccctacccgaaccgtaacccgggg

SEQ ID NO: 418823 - DNA, 613 bp, Homo sapiens
  misc_feature: GZ8MTXP02FU1P7.21.78.H01.1.454.CMB.2.raw
  modified_base (390)..(390): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgcaggctccgagggaggcctggagtggatctcactttatttatagtggtggtaccccacatactacacagactccgtgaagggccattcaccntctcagaagacaattccaaggaacacattagtatacttacaaatagaaataacctagaagacggaccgaacggacacgggaccaatgttattacgtggtcggtgggggtactacgttttaccgttacggtacccccggttacgggggcccggggtaaacccgtcgggtaccctaccccggtcccttaccccccgaccccttacccgaccccgtaaacccgggg

SEQ ID NO: 418824 - DNA, 642 bp, Homo sapiens
  misc_feature: GZ8MTXP02ISWIW.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtgggtcccgccgaggctccgaggggaacggccgtggagtggatcctactactttatttatagtggtcgtaccccacatactacacacgactccgtgaacgggccgattccacatctacagaaagacaaacttccgaaaggaacactatttagtaactcttacaaatacgtaaataaaccgtgacgaggacccgaaggaccacgggccaagtggttaacttacgtgtaggtcggggtactacgtttttaccgtcggtaccccggttcgggggacccggggtaaacccttcgggtacccgtaacccggttcccctacccccgtaaccccgttcccgaaacccgtaacccgggg

SEQ ID NO: 418825 - DNA, 583 bp, Homo sapiens
  misc_feature: GZ8MTXP02GY9Y9.21.78.H01.1.454.CMB.2.raw
  modified_base (430)..(430): a, c, t, g, unknown or other
  modified_base (440)..(440): a, c, t, g, unknown or other
  modified_base (474)..(474): a, c, t, g, unknown or other
  modified_base (480)..(480): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggaagggcctggagtggatctctactttattatagtggtggtacccacatactacacagactcgtgaaggccgatcacatctcaagaagacaaattccaagaacacattcgaatcctanaaaatgaaanaacctgagagcgaagacacggcatgtaattacgngtaggngggtctaactttacgttcggaccccgttcgggggacccgggtaaaccccgtggtaccccgtaacccgtccctcccccaaacccgtccccaaccgaaacccggg

SEQ ID NO: 418826 - DNA, 632 bp, Homo sapiens
  misc_feature: GZ8MTXP02GZUOJ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggcctcgagggaagggcctggagtggatcgtctactttatttagtagtggtggtaccccacatactacacagacctccggtgaacggggccattccacatctacagaagacaaattccaaggaacaccattgtaatcttacaaaatgaaataaccgtagagacggtaccgacggaaccaccgggacctagtggttaacttacgtggtcgggtagggggtctaacgttttacgtccggtaccccggtcggggggacccccggggtaacccttcgggttacccaaccccgggtttccaccccccgtaccccgtacccgtaacccgaacccgggg

SEQ ID NO: 418827 - DNA, 581 bp, Homo sapiens
  misc_feature: GZ8MTXP02HU2CW.21.78.H01.1.454.CMB.2.raw
  modified_base (437)..(437): a, c, t, g, unknown or other
  modified_base (443)..(443): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaaggcctggagtgggatctctacttatttatagtggtggtaccccactatactacacagactccgtgaaaggccgtattccaccatctacaagaagacaattccaaggaacacattgatcttaanaaatanaatacgtagagacgacgagacacgacagtagtattacgtggtacggtacgggtactactttacgtaccgacccggtacggggacccgggtacccgtcgtaccgacccgtcccaccccacccgtacccgaaccgaccgg

SEQ ID NO: 418828 - DNA, 585 bp, Homo sapiens
  misc_feature: GZ8MTXP02JRYLM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcacttatttatagtggtggtaccccacatactacacagactccgtgaagggccgattcaccatctcagaagacaattccaagaacacattgtatcttacaaatgaaatacctgagagacgagacacggcatgtatacgtgtacggtggggtacagtttacgtcggtacccccgtcgggggaccccggggtaacccctggggtaccctacccggtccctaccccccgacccctaccccgaacccgtaaacccgggg

SEQ ID NO: 418829 - DNA, 681 bp, Homo sapiens
  misc_feature: GZ8MTXP02GDI6O.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtccgccgaggcctccggaaggggaacgggccgtggagtggactctactactttatttagtaggtggtacggtaccccacgtactactacacgacgtaccgtccgggtaggaaacgggccgtacttccaacctactactacaagaaacgaactaaacttaccgaaaggaaaccactaattacgtacttacttaacaaatagtaaactaaccgtagagacggaccggaacggaccgaccggacctaagtagttacttacgtggttggtacggggtacttacgtttacgttaccggtaccccgggtacgggggaccccgggtaacccgtcgggtacccgtaccccgtcccctacccccgtacccctacccgaacccgtaaccccggg

SEQ ID NO: 418830 - DNA, 602 bp, Homo sapiens
  misc_feature: GZ8MTXP02J1BL8.21.78.H01.1.454.CMB.2.raw
  modified_base (355)..(355): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaggcctggagtggatctcacttatttatagtggtggtaccccanatactacacagactccgtagaacgggccattccaccatctacagaaagacaattcccagaacacattagtatcttacaaatagaaataacctgagagaccgagacgacggccatcgtattacgtggtggtggggactacgttttaacgtcggtacccccggttcgggggccccgggggtaaaccccgttgggtacccgtacccggttccccgtaccccctaccccgtacccaaccccgaaaccgggg

SEQ ID NO: 418831 - DNA, 651 bp, Homo sapiens
  misc_feature: GZ8MTXP02IOHNP.21.78.H01.1.454.CMB.2.raw
  modified_base (253)..(253): a, c, t, g, unknown or other
  modified_base (403)..(403): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtcctgagctctctgtgcngtctcgtgggttctcgagtggcgactacatgagcgtcgggtccgccgagggcctaccggaaggggaacgggccctaggggaggtcggacttctctaacttttatttaagtaggttggggtacgtaacccccactaataaccccccctaanacgaacgtaccgtccggtaagggaacgggccgtacttacccaactactactaacaaagaaacaactaactaccgaaagaaactactattagtaacttacttaaacaaataagtaaactaacgagacgacgacgagacacgacagtagtatacgtggtcggtaggtacttacgttacgtccggacccggtacggggacccggtaccgtcgtccgtacccgtccctaccccacccgtaccgaaccgaccg

SEQ ID NO: 418832 - DNA, 604 bp, Homo sapiens
  misc_feature: GZ8MTXP02JRVBB.21.78.H01.1.454.CMB.2.raw
  modified_base (298)..(298): a, c, t, g, unknown or other
  modified_base (478)..(478): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagcctggggggtccctgagactctcctgtgcagtctctgggttcgtcagtggcgactacatgagctggggtccnccaggctccaggggaagggcctggagtggatcgtcacttatttatagtggtggtaccccacatactacacagactccgtggaaacgggccgattcaccatctcagaagacaattccaaggaacacattgtatcttacaaatgaaatacctgagagacgaggacacggaccatgtattacngtagtggggactagtttaccgtcggtaacccccgtcgggggtacccgggggtaaaccccttggggtacccctaacccgggtcccttaccccccgaccccgttacccgtaacccgtaaaccccgggg

SEQ ID NO: 418833 - DNA, 772 bp, Homo sapiens
  misc_feature: GZ8MTXP02HM58Y.21.78.H01.1.454.CMB.2.raw
tcagtcgtcgctcgcacgaccggtgctcgatttagtgtgagtagtttgggtttgggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggtcggtcctagacgtactctccgtgtcgctacgtctcggttgggtccgtcgaggtcggactactactagtggacgtcggtccggtcccgccgacggccgtacgggaaggggaccggtcgtagggtaggtggtacttcctacttaactttagtttagtaggtaggttaccccggtaacctaactaacttaaccctaacaaccgtacgtacccgttcgggtaacgggaaccggggtacctaaccgttacccaaaccttacgttaccgtaacgaaaaggtaaacgtaacttaaaccttacggaaacgaaacctacttaaggttatacttacctaaaataaacgttaaacgtaaaacgtttacgagaaacggaccggaacccggaaacggaaccgaccggtactaagttagttaacttacggttgggtaggggttacgggtactttacggtttacccgccgggtaaccccgggtgggggtaccccggtaaccgtcggtacccgtaccccgtcccgtaccccctcccgtaaccgaacccccgg

SEQ ID NO: 418834 - DNA, 599 bp, Homo sapiens
  misc_feature: GZ8MTXP02JXTN5.21.78.H01.1.454.CMB.2.raw
  modified_base (441)..(441): a, c, t, g, unknown or other
  modified_base (485)..(485): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgaggggaagggcctgggagtggatctctacttatttatagtggtcggtaccccactatactacacagactccgtaggaacgggccgattccactatctacagaaacacaattccaagaacacattgtaatctaanaaatgaaatacctgagagaccgaggacacggacatgtattacgngtgggtcggggacttacgtttacgtacggtacccccggtcggggggaccccggtaaacccgtgggtaccctaccccgtcccgtcccccacccgtacccgaccgaaaccccgggg

SEQ ID NO: 418835 - DNA, 652 bp, Homo sapiens
  misc_feature: GZ8MTXP02G1ISW.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtgggaggaggcttgatccagccgtcgggggtccctgagactctcctgtgcagtctcgtgggttcgtcaggtggcgactacatgagcgtcgggtcccgccgaggcctccggaaggggaacggggcccgtagggaggtgggaacttccgtctaactttatttagtaggttgggtcggtaaccccacataactacacacgactccggtaggaacgggccctagttaccaccatcctacgaagaaagaacaacttaccaaggaaccactattacgtatcttaacaaaatgtaaataccgtagagacgacgaggacacggcagtagttatacgtgtcggtgggacttacgtttacgtacggtaccccggtacgggggaccccggggtaacccgtcggttaccgaaccccgttccctacccccaccctaccccgaaccgtaaccccggg

SEQ ID NO: 418836 - DNA, 613 bp, Homo sapiens
  misc_feature: GZ8MTXP02H5QP4.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtccgccaggctccgagggagggccgtggagtggatctctacttatttagtagtggtgtacccacatacacacagactccgtgaaacggccgattcaccatctacacgaagacaattacccgaaggaacaacgtattgtaacttcttacaaaatgtaaaactaaccgttagaacgagcccgaaggaccacggtaccaattgtaattacgtggtcggtaggggtactacgtttacgtcgtaccccggtacgggggacccggggaacccttcgggtaccaacccggttcccacccccgaccccttccgaacccgtaacccgggg

SEQ ID NO: 418837 - DNA, 561 bp, Homo sapiens
  misc_feature: GZ8MTXP02F0IQE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctggagtgggatcgtcactttatttatagtggtggtacccacatactacacagactccgtgaagggccgattcaccatctcagaagacaatcagaacacattgtatctacaaatagaaataacctgagagcgaagacacggccatgtatactgtgtaggggctactttacgtcgacccgtcggggcccggggtaaaccgtcggtcctaccgtccgtacccccacctcccgaaccgaacccggg

SEQ ID NO: 418838 - DNA, 593 bp, Homo sapiens
  misc_feature: GZ8MTXP02JWJV2.21.78.H01.1.454.CMB.2.raw
  modified_base (447)..(447): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttcgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgaggggaaggggccgtggaggtggatctctacttattatagtggtggtaccccacatactacacagactccgtggaacgggccgattccacctatcctacaagaacgacaattccaaggaacactattgtatcttanaaatagaaactacctgagacgaccgagacacggccatgtatacgtgtaggtggggctacgtttaccgtcggtaccccgtcgggggaccccgggaccgtcggtacctacccggtccctcccccgacccctcccgaaccgtacccggg

SEQ ID NO: 418839 - DNA, 564 bp, Homo sapiens
  misc_feature: GZ8MTXP02GKHB5.21.78.H01.1.454.CMB.2.raw
  modified_base (478)..(478): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccgccgaggctccgaggggaacggcctggagtggatcgtcactttatttatagtggtgtaccccactatactacacagactccgtgaagggccgattccacatctcagtaaagacaattccagaacacgattgtatcttacaaatgaaatacctgagagccgagacacggcatgtattacgngtaggtgggctacgtttactacgaccccgtggggcccgggaacctcggtaccaccgtacctcccccacctcccgaccgaacccggg

SEQ ID NO: 418840 - DNA, 689 bp, Homo sapiens
  misc_feature: GZ8MTXP02J21VI.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtcggggggtccctgagactctcctgtgcagtctctgggttcgtcaggtggcgactacatgagcgtgggtccgccgaggcctccgagggaacggggcctgggagtggactcgtctactttaatttataaggtggtacggtaaccccaacgtattactaaccacaacggactcccgggtaggaaacggggccgtattccaacctactactaccaaggaaacgaactaacttacccgaagaacactatttgtaacttacttacaaaattgaaactaaccgtgaagacgaccgagaaccgacgggacctagtgtacttaacgtggttacgggtaggggactaacgtttacgtaccggtacccccgggtacgggggtaccccggggtaaacccccgtcggggttaccccgacccggttaccccctacccccgtacccccgtaacccgaacccgtaaaccccgggg

SEQ ID NO: 418841 - DNA, 731 bp, Homo sapiens
  misc_feature: GZ8MTXP02GRXBI.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttacaaaaggtgtccagtgtgaggtgctagttggtggagacgtgggaggaggcttgatccgagccgtgggggtccctgagactctcctgtgcagtctcgttgggttcgtcgagtggcgactacagtgagcgtcgggtccgccgaggccgtccggaaggggaacgggccgtaggggtaggtggtacttccgtactaactttaatttacgttaggtcgggtacggtaaccccactaactaactaacacgaacgtaccgtccgggtaggaaacgggccgtaacgttaccaacctactacctacaaacggaaactaactaaacgttaccgaaaggaaacctacgtaattagtaacttacttaactaaaataggtaaactaccgtagaacgacggaccggaagaccgacgactatagttacttacgagttcgggtacgggtacttaacgtttaccgttaccgggtacccccgggtacgggggtaccccggggtaacccgttaacgggtccctaacccccggttccccgtaccccccgaaccccggtaccccgaacccggtaaccccggg

SEQ ID NO: 418842 - DNA, 660 bp, Homo sapiens
  misc_feature: GZ8MTXP02JSGF7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcaggtggcgactacatggagcgtcggggtccgccgagggcctccgaggggaacgggcctgggacgtggatctctactttattataggtggtgtaaccccactatactacacagactccgtaggaacgggccgtattccaccatctacagaaacgacaacttaccaaggaacactattgtattactacaaaatagaaataacctagacgacggaccgaacggacgacggcctaagtcgttaattacgtaggttggtacgggggtacttacggtttaccgttaccggtaacccccgggttcggggggacccccggggtaaacccgttcggggtaccccgtaacccggttcccctacccccctaccccgtaccccgaaccccggaaaccccggg

SEQ ID NO: 418843 - DNA, 554 bp, Homo sapiens
  misc_feature: GZ8MTXP02IWLEM.21.78.H01.1.454.CMB.2.raw
  modified_base (532)..(532): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctggggttcgtcagtggcgactacatgagctggggtcccgccagggctccgaggggaagggtctggagtgggatctcacttatttatagtggtggtacccacatactacacagactccgtgaaacgggccgattcacatctcagaagacaattccaagaacacattgtaatcttacaaatgtaaataacctgagagaccgagacacggccatgtatacgtgtggtgggctatttactgacccgtggggacccgggaacctggtccaccggtcnccccgacctccaccgtaaccgg

SEQ ID NO: 418844 - DNA, 725 bp, Homo sapiens
  misc_feature: GZ8MTXP02GAJKS.21.78.H01.1.454.CMB.2.raw
  modified_base (509)..(509): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgatccagccgtgggggtccctgagactctctgtgcagtctcgtgggttcgtcaggtggcgactacagtgagcgtcgggtccgaccgaggcctccggaaggggaacggccgtaggagtggactcgtctaacttttagtttaagtaggtggttacggtaaccccaactacgttaacctaacacgaacgtaccgtccgggtagggaaacggggtcccgtacttacccaacctatcctacgaagaaacgaactaaacgttccgaaaggaaaccactattagtaactacttaanaaaatcgaaaacttaaccgtagaacgacggaccggaacggacgaacggctaagttgtaagtttacgtggtaggttcggggtacttaacgttttacccggtaccggtacccccgggttcggggggaacccccggggttaaaccccgtgggttacccccaaccccggttccccctaccccccgtaaccccgtaccccgaacccggtaaacccccgggg

SEQ ID NO: 418845 - DNA, 626 bp, Homo sapiens
  misc_feature: GZ8MTXP02J3OTJ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtccgccgaggcctccggaggggaacggggcctgggagtggactcgtctacttatttagtagtggtacgtacccacatactacacagactccgtagaacgggccattcactatcacaagaagacaaacttaccaagactacattagtaacttacttacaaatagaaactaaccgtgaagacggaccgaaggaccgacggacctagttgtaatacgtgtcggtacggggactacgtttacctcggaccccggtacgggggtaccccggggtaacccgtcgggtaacccaccgtcccctacccccgacccgtacccgaaccgtaaccccggg

SEQ ID NO: 418846 - DNA, 550 bp, Homo sapiens
  misc_feature: GZ8MTXP02JG99E.21.78.H01.1.454.CMB.2.raw
  modified_base (355)..(355): a, c, t, g, unknown or other
  modified_base (468)..(468): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacatgagctgggtccgccaggctccgagggaggcctggagtggatctcacttatttatagtggtggtaccccanatacacacagactccgtgaacggccgattcacatctcagaagacaattccaaggaacacattgtaatctacaaatgaaataacctgagagaccgaggacacggcatgtatacngtgtgggctagtttactcgacccgttcggggcccgggaacctggtaccaccggtcctacccccgacctcccacgtaacccgg

SEQ ID NO: 418847 - DNA, 666 bp, Homo sapiens
  misc_feature: GZ8MTXP02HW7YE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtgggaggaggcttgatccagccgtgggggtccctgagactctcctgtgcagtctcgttgggttcgtcgaggtggcgactacatgagcgtcgggtccgccgaggcctccggaggggaacggggccgtagggaggtggattcgtactacgtttaattagtaggtggtacggtaccccacgtaatactacacagacgtccggtagaacgggctacttcaccatctacaagaacgaacaacttaccgaagaacaactattagtacttacttaactaaagtacgtaaacttaacgtagagtaacggaccgaacggacgaccggactaacgtgttaagttacgtggttggttaggggtacttacgtttacgttaccggaccccggtacgggggacccggggtaacccgtcggtacccgacccgttaccccacccctacccccgtacccgaacccgtaaacccgg

SEQ ID NO: 418848 - DNA, 633 bp, Homo sapiens
  misc_feature: GZ8MTXP02FXBOM.21.78.H01.1.454.CMB.2.raw
  modified_base (345)..(345): a, c, t, g, unknown or other
  modified_base (512)..(512): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggcctccgaggggaaggcctggagtgggatcgtcactttattanagtggtggtaccccacatactacacagactccgtagaacgggccgattccaccatctacaagaaagacaaattcccaaggtaaaccacgtatttgtaactcttacaaaatgaaacttaacctagaacgacgaccgaaggaccaacgggccaattcggtaatttacgnggttacggtggggactacgtttaaccgttcggacccccgttgggggccccggggtaaacccgtcggggtcccaacccggttccccgtaccccccaacccgtcccgaaacccgaacccgggg

SEQ ID NO: 418849 - DNA, 575 bp, Homo sapiens
  misc_feature: GZ8MTXP02ICW1C.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggcctccgaggggaagggcctggagtggatctctacttatttatagtggtggtaccccacatactacacagactcgtgaaggccgattccaccatctcagagacaatccagaacacattgtatctacaaatgaaataactgagagaccgagacacggccatgtattacgtgtggtggggctagttttacgtacgtaccccgtcgggggtacccggggaacccgtcgggtccctacccgtccgtaccccccacccctacccgaacccgaacccggg

SEQ ID NO: 418850 - DNA, 620 bp, Homo sapiens
  misc_feature: GZ8MTXP02FY1U6.21.78.H01.1.454.CMB.2.raw
  modified_base (409)..(409): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggcctccgaaggggaaggggccgtggagtggatctctactttatttatagtggtcgaaccccacatacacacagactccgacgaaggccgatcaccatctacagaanacaattccaagaacacattagtatcttacaaattgaaactaaacctgagacgaccgaaggacacggaccatcgtaattacgttggtaggtggggtactacgttttaccgttacggaccccggtacgggggacccggggtaaaccccgtgggtaccccgtaccccgttccccgtacccccgtaaccccgtacccgaaccccgaaacccgggg

SEQ ID NO: 418851 - DNA, 695 bp, Homo sapiens
  misc_feature: GZ8MTXP02G1RJV.21.78.H01.1.454.CMB.2.raw
  modified_base (459)..(459): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtcctgagactctcctgtgcagtctcgtgggttcgtcaggtggcgactacatgagcgtcgggtccgccgaggcctccggaggggaacggccgtggagtggactctctacttattagtagtggtcgtacccacatactacacacgactccggtagaacggccgattccacatctacagaaacacaactcccgaaagaaactactatttagtaacttaccgttaaanaaaagttcgtaaaactaaccgtgaaacggacggaaccccggaaaggaacccacgggacctaagttacggttaaactttcgtgggttacgggtcggggttaactttaacggttttacccgtacccggggtacccccggggtacggggggtaacccccgggttaacccgtcgggtacccccgtaccccggttccccctaccccccgaccccgttacccggaaaccgtaaccccggggg

SEQ ID NO: 418852 - DNA, 571 bp, Homo sapiens
  misc_feature: GZ8MTXP02JK9HC.21.78.H01.1.454.CMB.2.raw
  modified_base (298)..(298): a, c, t, g, unknown or other
  modified_base (476)..(476): a, c, t, g, unknown or other
  modified_base (542)..(542): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccaggctccgagggagggcctggagtggatcgtcacttatttatagtggtggtaccccacatactacacagactccgtgaacgggccgattcacatctacagaagacaattccaaggaacacattagtatacttacaaaatgaaataacctgagagccgaggacacggcatgtacttngtggtggggctacgtttacgtcgaccccgtgggggcccggaacccgtggtcccgaaccggttcccncccccgtaaccctcccgaaccgaaccggg

SEQ ID NO: 418853 - DNA, 590 bp, Homo sapiens
  misc_feature: GZ8MTXP02FQWOU.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggccactacatgagctgggtcccgccaggctccgaggggaagggcctggagtggatctcacttatttatagtggtggtaccccacatactacacagactccgtgaacgggccgattcaccatctacagaaagacaattccaagaaacactattgtatctttacaaaatgaaataacctgagagaccgaaggacacggcatgaattactgtaggtggggctatttacgtcggaccccgtgggggccccggggtaaacccgtggtacccgaacccggttccctaccccccacccgtcccaacccgaaacccgggg

SEQ ID NO: 418854 - DNA, 645 bp, Homo sapiens
  misc_feature: GZ8MTXP02ICBW5.21.78.H01.1.454.CMB.2.raw
  modified_base (258)..(258): a, c, t, g, unknown or other
  modified_base (332)..(332): a, c, t, g, unknown or other
  modified_base (467)..(467): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtcggggggtccctgagactctcctgtgcngtctcgtgggttcgtcaggtggcgactacatgagcgtcgggtccgccgaggctccggagggaacgggcctaggngtggatcgtctacttattagtagtggtcgtacccactatacctacacacgactccggtagaacgggcccgtattccgaccatcctacaagaacgactaacttcgaaagaacactattagtattcttacaaaatanaaactaaccgtagaacggacgccggaaaggacctacggctattagtactacgtggtagggtcgggtacttacgttttaccgtacggtaccccggtacggggggtacccccggtaacccgtcggggtaccccaacccggttcccctacccccaccccgttaccaacccggtaaccccgg

SEQ ID NO: 418855 - DNA, 712 bp, Homo sapiens
  misc_feature: GZ8MTXP02HT2CL.21.78.H01.1.454.CMB.2.raw
  modified_base (366)..(366): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggcttgatccagccgtgggggtcctgagactctctgtgcagtctcgtgggttcgtcagtggcgactacatgagcgtgggtccacgaggctaccgagggaacggcctaggagtggatctctactttatttagtagtggtacggtaccccanactactacacacgactccgtagaacgggccgtattccaccaatcctacgaagaaacgactaaacttcccgaaaggtaaacctacgtatttacgtaaacttctttaaaccaaaagttacgtaaaacttaaacccgtagaacgtaacggaccccggaaggaaccgaccgggacctaagttagttaacgttacgtgggttcgggtaggggtaccttaacgttttaccgtttaccgggacccccggttacgggggacccccgggggtaaaacccttcggggttaacccccaccccgggttaccccctacccccgtaaccccccttacccgaaacccggtaacccccgggg

SEQ ID NO: 418856 - DNA, 752 bp, Homo sapiens
  misc_feature: GZ8MTXP02IH6M7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgttgggttcgtcagtggcgactacatgagcgtcgggtcccgccgaggctccggaaggggaacggccgtggagtggatctctactttatttagtagtggtacgtaccccacatactacacagacctccggtaggaacgggtcccgtaattacccacctatccctacaagaaacgaactaaacttacccgaaaggtaaaccaacttaagtttacgtaaacttaccttaacaaaaacttagtaaaacttaaacccgtaggaaacggaacgggacccggggaaccgaccgggtaaccctagttaacgttaatttaaccgttgggttacgggttacgggggtacttaaacgttttaccgtttacccggaccccgggtttacggggggaacccccgggggttaaacccgtcggggttaaccccgtaacccccggttccccgttaccccccctaaacccccgtaccccgaaaccccggttaaaaccgggtcccccg

SEQ ID NO: 418857 - DNA, 570 bp, Homo sapiens
  misc_feature: GZ8MTXP02GIXN4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgaggggaacggcctggagtggatctaacttatttatagtggtggtaccaccacactacacagacctcgtgacgggccattcaccatctcaagaaagacaattaccgaaggaacactattgtatcttaacaaatagaaactaacctgaagacgaccgaggacacggccaagtcgtatacgtgtgtcggggactatttacgtcgacccggtggggacccgggacctcggccaccgtccaccccaccctccaccgaacggtcccc

SEQ ID NO: 418858 - DNA, 669 bp, Homo sapiens
  misc_feature: GZ8MTXP02HIDAH.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtgcgactacatgagctgggtccgccgaggctccgaggggaaggccgtggagtggatcgtactactttatttataggtggtcggtaaccccacgatactacaacacgtaactccggtaggaaacggggccctagttccaacctatcctacgaaagaaacgactaaacttaccgaaggaaactacatttagtaattctacgtaaaatgtaaactaaccctgaagaacgcccgaaggaccgacggctaagtgtaattacgtgttagggacggggtacttaacgttttaacgtccggacccccggtcgggggtacccccggggtaacccgttggggtaccccaacccgggttcccctacccccgtaccccgttacccgaaccccggtaaacccgggg

SEQ ID NO: 418859 - DNA, 589 bp, Homo sapiens
  misc_feature: GZ8MTXP02G0WAH.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccaggctccgagggaggcctggagtggatctctacttatttatagtggtgtacccactatactacacagactccgtagaagggccattccacatctacagaacgacaacttaccgaaggaaacactattagtaacttcttaacaaaatagaaataacctagaggacgaccgaaggacacggccaagtagttatacgtggtaggtggggactacgtttacgtcgaccccggtcgggggacccgggtaaccgtcggtccgacccgtcctccccaccctcccgaccgtaaccggg

SEQ ID NO: 418860 - DNA, 656 bp, Homo sapiens
  misc_feature: GZ8MTXP02HWY6X.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccgaggctccgagggaacggggcctggagtgggatcgtctactttaatttataaggtggttaggtaccccacatactacacaagactccggtaggaacgggccgattccaaccatcctacaagaaacgaacaaattcccaaggaaacaactattagtaacttctactaaaatagtaaaactaaaccgttagaagaacggacccgaaggaaccgacgggacccattacgttaattacgtagtgggtgggggactacgtttacgttcggtaccccggtcgggggaccccgggtaaacccgttgggtacccgtacccggttacccctcccccgaccccgtaccccaacccgtaacccggg

SEQ ID NO: 418861 - DNA, 605 bp, Homo sapiens
  misc_feature: GZ8MTXP02H9VCA.21.78.H01.1.454.CMB.2.raw
  modified_base (359)..(359): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaagggcctggagtggatctctacttatttatagtggtggtaccccanatactacacagactccgtagaagggccgattcaaccatctacagaagacaattccaagaacactattagtatcttacaaatagaaataacctgaagagaccgaaggacacggacacgtgtattactgtaggtggggtactacgtttacgttcgtaccccggtcgggggtaccccggggtaaacccgtcgggtacccgaacccggttccctacccccgacccccgtacccgaacccgaaacccgggg

SEQ ID NO: 418862 - DNA, 690 bp, Homo sapiens
  misc_feature: GZ8MTXP02FUADQ.21.78.H01.1.454.CMB.2.raw
  modified_base (301)..(301): a, c, t, g, unknown or other
  modified_base (342)..(342): a, c, t, g, unknown or other
  modified_base (357)..(357): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcgagtggcgactacatgagcgtgggtccncaggctccgagggaggctggagtggatctctactttattanagtggtgtaccccanactactacaacagacctccggtagaacggggtccattccgaaccctatcctacgaagaaacgtaacaaacttaccgaagaaacacctaagtttacgtattacctataaaattacgaaaacttaacccgagaaggaacgggacccgaaagggaaccgaaccgggacctaagttgttaaaactttcgtagggttagggtacgggggtacctttaacgttttaccgtacgggtaccccccggtacggggggtaccccgggtaaacccgtcggggttacccaccccgggttacccctcccccccgtaaccgtacccccgaaaccggaacccccgggg

SEQ ID NO: 418863 - DNA, 712 bp, Homo sapiens
  misc_feature: GZ8MTXP02I0P1S.21.78.H01.1.454.CMB.2.raw
  modified_base (280)..(280): a, c, t, g, unknown or other
  modified_base (293)..(293): a, c, t, g, unknown or other
  modified_base (296)..(296): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtggtttcgtgtaggctattacaaaaggtgtccagtgtgaggtgcagttggtggagactggaggaggcttgatccagccgtgggggtccctgagctctcctgtgcagtctctgggttctcagtggccatacntgagcgtcggccncgnggtcctacggagggacggcgtaggtagtgtattctactatttagtttagtaggtggtacgtacccactactacacacacgtacctcggtaggaacgggtcctacttccaactagtacctacgaagaaacgtaactaaacgtacgaaacgtaaacctacgttaagtttacgtaacttacttaaacgtaaaacttaacgtaaaacctaaacgtaggaacgacggaaccgggaaacggacccgtaccggtactaaagttcgttaacgttacgttacggttcgggtacgggttaccggtttaacgtttaccgttaccggtaccccgggtaccgggggtacccggggtacccggttaaccggtacccgtacccggtaccccgtacccccgtacccccgtaaccccgtaacccgtaacccgg

SEQ ID NO: 418864 - DNA, 743 bp, Homo sapiens
  misc_feature: GZ8MTXP02FQ2CG.21.78.H01.1.454.CMB.2.raw
  modified_base (255)..(255): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcngtctcgtggttcgtcaggtggcgactacagtgacgcgtcgggtcccgccgacggcctaccggaaggggaacgggtccgtaggaggtggactctactaacttttaatttaagtaggttgggtcggtaacccccactactaactaacacgaacgtaccgtccggtaggaacggggtccgtacttccaactacttcctaacgaagaaacgtaacctaaacttacccgaaaggaaaccacttaaagtttacgttacttaccttaactaaaagttacgaaaactttaacccgaggaacggacggacccggaaggaaccgacggacctaagttacgttaacttacgtgggttacggggtacggggtactttaacgtttaccgttccgggtacccccggggttacggggggaccccgggtaacccgtcgggttaccccgtaccccggttcccccgtacccccgtaccccgtaccccgaaccggtaacccccgggg

SEQ ID NO: 418865 - DNA, 639 bp, Homo sapiens
  misc_feature: GZ8MTXP02INGTZ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagcctggggtctccctgagactctcctgtgcagtctcgtgggttcgtcagttggcgactacatgagcgtcggggtcccgccgaggcctccgaggggaacgggcctgggagtggatctctactttattatagtggtcgtaccactatactacacagctccgagaacgggcctattcacctatctacaagaagacacttaccaaggaaccagtattagtatcttaacaaaattagaaacttacccgtaggacgaaccggaccggaaggacacggacctagttagtaacttacgtagtcgggttaggggacttaacgtttacgttccgaaccccggttcgggggaccccggggtaaaccttccgggtaccgtaccccggttaccctacccccgtaacccgttacccgaaaacccccgg

SEQ ID NO: 418866 - DNA, 633 bp, Homo sapiens
  misc_feature: GZ8MTXP02JZDB9.21.78.H01.1.454.CMB.2.raw
  modified_base (297)..(297): a, c, t, g, unknown or other
  modified_base (359)..(359): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccnccgaggctccgaggggacggcctggagtggatcgtctacttatttatagtggtgtaccccanatactacacagactccgtgaaacgggccgattccactatctacaagaaagacaaattcccgaaaggtaacacgtatttagtaacttcttaacaaaagttgaaaacttaaccgtgaacggacggacccgaaggaccacgggacctaagtgttaacttacgtggtacgggtcggggacttacgtttaccgtccggtaccccggtcgggggaccccggtaacccgtggtacccaacccggtccctacccccgacccgtaccgaacccggaacccggg

SEQ ID NO: 418867 - DNA, 722 bp, Homo sapiens
  misc_feature: GZ8MTXP02FWX53.21.78.H01.1.454.CMB.2.raw
  modified_base (365)..(365): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtcggcgactacatgagcgtcgggtccgccgaggcctccgaaggggaacgggcctggagtggatcgtctactttattagtagtggtgacccanatactacacacgactccggtagaacgggccgacttacacctatcctacagaaacgactaaattacccgaaggaaacactaatttacgtaactcctttaacaaaagttacgtaaaacgttaaacccgtaggaacgaaaccgggaccggaaaccggggaaccaaacccggggaccctaagttacggttaaacgtttaaacggttgggttacgggtacgggggtcttaaacgttttacggttacccgggtacccccgggttacggggggacccccggggttaaacccgtccgggggttaccccaacccggggttcccctacccccctaacccgttacccccgaacccgtaaaccccgggg

SEQ ID NO: 418868 - DNA, 657 bp, Homo sapiens
  misc_feature: GZ8MTXP02G9KZW.21.78.H01.1.454.CMB.2.raw
  modified_base (435)..(435): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgaggcctaccggaggggaacggccgtggagtggactctctaactttatttagtaggttaggtcggtaaccccagtactaactaacacaacgtacctccgggtagaaacggggccacttcaccatcacaagaanacaatccgaagaacacatttagtattactaactaaatacgtaaaataaccgtagaacgacgaccggaaggaaccgacggactagtcgttatacgtggttggtcggggacttacgttttaccgtacggtacccccggtacgggggtaccccggttaacccgtcgggttaccctaccccggtcccctaccccccgaccccttacccgaacccggtaaacccggg

SEQ ID NO: 418869 - DNA, 625 bp, Homo sapiens
  misc_feature: GZ8MTXP02G4MNJ.21.78.H01.1.454.CMB.2.raw
  modified_base (501)..(501): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaaggcctggagtggatctcactttattagtagtggtgtacccacatactacacagactccgtagaacggccgattcacatcgacaagaagaactaattaccgaaggaaacactaattagtatacttacaaaattgaaaacttaaccctagaagaacgaccgaaaggaccacggaccaatgtattacgngtaggtggggacttaacgtttaccgttacggaacccccggttcgggggaccccggggtaaacccgtcggtacccgtaaccccggttcccaccccccgaccctaccccgaaccgaaaccccgggg

SEQ ID NO: 418870 - DNA, 602 bp, Homo sapiens
  misc_feature: GZ8MTXP02HK6W9.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttctcagtggcgactacatgagcgtgggtccgccaggctccgagggaaggcctggagtggatctctactttatttatagtggtggtaccccacatactacacagactccgtaggaacggccgattccgaccatcctacgaagaaacgacaacttcccgaaaggaaccaactatttacgtaattacttacaaaatgaaataaccttgagacgccgagacgacggccagtagttatacgtgtggtgggactagtttacgttacgacccgtcgggggccccgggaacccgtcgggtccaacccggtccctacccccgacccgtcccgaacccgaacccgg

SEQ ID NO: 418871 - DNA, 564 bp, Homo sapiens
  misc_feature: GZ8MTXP02F9RNP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtccgccaggctccgaggggaaggcctggagtggatctcactttatttatagtggtgtacccacatactacacagactccgtgaagggccgattcacatctcagaagacaattccaaggaaacactattagtatcttacaaaatgaaataacctgagagcgagacacggcatgtattactgtggtggggctacgtttacgtcgaccccgtacgggggcccggggtaaccgtggtccaccgtcctacccccaccctacccaccgaacccggg

SEQ ID NO: 418872 - DNA, 699 bp, Homo sapiens
  misc_feature: GZ8MTXP02HEE0L.21.78.H01.1.454.CMB.2.raw
  modified_base (287)..(287): a, c, t, g, unknown or other
tcagtcgtcgctcgcacgaccggtgctcgatttagtgtgagtagtttgggtttggggggaggaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccaggccggtcgggggtccctgagactctcctgtgcagtctcgtggttctgagtgcactacntggagtcgtcgggtcccgccgaggcctccggaaggggaacggccgtaggagtggattcctacgtactttagtttataggtggtacggaaccccctagaacttaacctaaccaacgtaacgtacccgtacccgggtagggaaaccggggtcccttaaacttcccaaaccctaaattccctaacgaaacggtaaaacgtaacctaaacgtttacccgaaaggtaaacctacgtaagtttacgttaactacttaacaaaatacgtaaactacgtagacgacgaccgagaccacggacctagttcgtaatcgtggtacggcggtcttacgtttacgtccggacccggtacggggacccggtaaccgtcggtccacccgttcccgaccccctacccgtacccgaaccgtaacccggg

SEQ ID NO: 418873 - DNA, 783 bp, Homo sapiens
  misc_feature: GZ8MTXP02H3VWP.21.78.H01.1.454.CMB.2.raw
  modified_base (257)..(257): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccaggccgtgggggtcctgagactctcctgtgcngtctcgtgggttcgtcaggtgcgactacatggagcgtcgggtccgccgaggcctaccggaggggaacggccgtagggagtggtactctacttactttatttaagttacggtagggttcggtaaccccacgtaacttaactaacacgaacgtaaccgttccgggtacggaacggggcccgtagttaccacctattacctacgaaagaaacggtaacctaaacttacccgaaaggtaaaccaaccgttaagtttagtaacttacttaaactaaaagttacgtaaaacttaaaccgtagaacggacggacccggaaggaaccgaaccgggtacctaaggttacgttaacgtttaacgttggggttacgggttacgggggttacctttaacgttttaacccggtaccgggttacccccgggggttaccggggggtaaccccggggtaaacccggtttccgggtaccccgtaaacccggttcccccttaaccccccgaaccccgttaccccgaaacccggtaaaccccggg

SEQ ID NO: 418874 - DNA, 611 bp, Homo sapiens
  misc_feature: GZ8MTXP02ID6TO.21.78.H01.1.454.CMB.2.raw
  modified_base (370)..(370): a, c, t, g, unknown or other
  modified_base (379)..(379): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgcagtggcgactacatgagcgtgggtcccgccgaggctccggagggaacgggcctggagtgggatccgtctactttagttataggtggtacgtaccccanatactacanacgactccggtgaacgggcctattccactatctacaagaaacgtacaaacgttccaaggaaacacgtatttagtactcttaacaaatagaaactaccgtagagacgacgaagacacggcattgtaatcgtgtggtgggacttagtttaccgtcggaccccgtggggggcccccggggtaccgtcggtcccgaccgttccccacccccgtaccctccgaacccgtaacccggg

SEQ ID NO: 418875 - DNA, 608 bp, Homo sapiens
  misc_feature: GZ8MTXP02G0DEB.21.78.H01.1.454.CMB.2.raw
  modified_base (363)..(363): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgaggcctccgaggggaaggcctggagtggatctctactttatttatggtggtggtaccccanatactacacagactccgtagaacgggccgattccacatcacagaagacaacttccaaggaacacattagtactactaacaaatgaaataccgtagacgacgccgaaggacacggacagtgtaattacgtggtaggtcggggtacttaacgtttaccgttcggaccccggtcggggggaccccggtaacccgtcgggtacccaacccggttccctacccccgacccgtacccgaaccgaacccggg

SEQ ID NO: 418876 - DNA, 583 bp, Homo sapiens
  misc_feature: GZ8MTXP02FMQG0.21.78.H01.1.454.CMB.2.raw
  modified_base (403)..(403): a, c, t, g, unknown or other
  modified_base (410)..(410): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagctgggtccgccaggctccgaggggaagggcctggagtggatctcactttatttatagtggtaggtacccacatactacacagactccgtagaaacgggccgattccaccgatctanaagaaanacaattccaaggaacactattcgtatcttacaaatgaaataacctgagagaccgaagacacggacagtcgtaattacgtggtacggtggggacttattttacgtcgtacccgtcgggggcccgggaaacctggtacccaccgtcctacccccgaccctccaacccgaaccggg

SEQ ID NO: 418877 - DNA, 626 bp, Homo sapiens
  misc_feature: GZ8MTXP02I7JCD.21.78.H01.1.454.CMB.2.raw
  modified_base (361)..(361): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccgccaggctccgagggaagggcctggagtggactctcactttatttataggtggtacggtaccccanatactacacagactccgtgaacgggcctatcgacatctacagaagactaataccaaggaacactattacgtatcttactaaactagtaaactaacctagagacggaccgaaggaccgacgggacctaagttgtaacgtttacgtgttagggtgggggtacctacgttttaacgtcggtaccccggttacgggggacccggggtaacccgtcggtaccgtacccggtacccgtcccccgaacccctcccgaacccgtaaacccggg

SEQ ID NO: 418878 - DNA, 678 bp, Homo sapiens
  misc_feature: GZ8MTXP02FXUNA.21.78.H01.1.454.CMB.2.raw
  modified_base (644)..(644): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgccgaggcctccgaaggggacgggcctgggagtggactctctactttatttataggtggtcggtaaccccacatactacacagactccggtagaacggggcctattcaccatctacgagtaaacactaaacttcccgaaaggaacctactagtttacgtaactccttaacaaaagttgaaaacctttaacccgtgaacgacgggacccgaaaggggaccaacgggccctaaagttcggttaaactttacgtgggttgggttacggggactttacgtttaaccgttcggtaacccccggtcgggggaaccccgggtaaacctcggggtaccaaccccggttcccnccccctaacccgtacccgaaccgtaaaccccggg

SEQ ID NO: 418879 - DNA, 676 bp, Homo sapiens
  misc_feature: GZ8MTXP02GZXY2.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgactccgaggccgtcggggggtccctgacgactctcctgtgcagtctcgtgggttctcgaggtggcgactacatgagcgtgggtcccgccgaggcctaccggaggggacggccgtagggagtggactccgtactactttatttagtaggtgggttcgtaaccccactatactacactacgactccggtaggaaacgggccgtattaccactactctacgaaagaaacgaactaaacttacccgaaagtaaaccacgttatttacgttaactcctttaaacaaaattcgtaaaattacccgtaggaacgacgaccggaagaaccacggacctagttagtattacgtggtagggtacgggtcttaacgtttacgtccggtaacccggggtcgggggaaccccgggtaccgtcgtaccgtaccccgtcccgtacccccaccctaccgaaccgtaacccgg

SEQ ID NO: 418880 - DNA, 616 bp, Homo sapiens
  misc_feature: GZ8MTXP02G467W.21.78.H01.1.454.CMB.2.raw
  modified_base (402)..(402): a, c, t, g, unknown or other
  modified_base (418)..(418): a, c, t, g, unknown or other
  modified_base (425)..(425): a, c, t, g, unknown or other
  modified_base (444)..(444): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatggagcgtggggtcccgccgagggcctaccggaaggggaacgggccgtaggggagtgggtatacttaaactttatttagtagttgggtcgtaccaccacactacacagactccgngaacgggcatcaccanctcaganactaatcagaacacattanattactacaaatagaaataacgtgagacggaccggaggaccacggacagttacgtatttacgtggtggtacgggccttaatttaccgacggtacccccggtgggggaccccgggtaacctcggtccgtacccgtccctacccccgaccctacccgaacccgaacggtccccc

SEQ ID NO: 418881 - DNA, 571 bp, Homo sapiens
  misc_feature: GZ8MTXP02HD1Y6.21.78.H01.1.454.CMB.2.raw
  modified_base (299)..(299): a, c, t, g, unknown or other
  modified_base (361)..(361): a, c, t, g, unknown or other
  modified_base (370)..(370): a, c, t, g, unknown or other
  modified_base (372)..(372): a, c, t, g, unknown or other
  modified_base (377)..(377): a, c, t, g, unknown or other
  modified_base (394)..(394): a, c, t, g, unknown or other
  modified_base (397)..(397): a, c, t, g, unknown or other
  modified_base (477)..(477): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtggttcgtcagtggcgactacatgagcgtgggtccnccgaggctccgaggggaacggcctggagtggatctcactttatttatagtggtgtaccccanatactacananctcgngaacggccatcacatcncanaagacaatcgagaacacattagtatctacaaatagaaataacctgaagagaccgaagacacggcagtgtaatacgtgtgnggggtactactttacgtacgtaccccggtcgggggcccggggtaacctcggggtccacccgtcccgtcccccacccctccgaacccgaacccgg

SEQ ID NO: 418882 - DNA, 702 bp, Homo sapiens
  misc_feature: GZ8MTXP02JAFPY.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgccgaggcctccgaggggaacggccgtggagtggatctctactttattatagtggtgtaccccactatactacacacgactccggtagaaacgggtccgtaacttccgaaccaagttcctaacgaaagaaaacgaacctaaaatttacccgaaagggtaaaccaactaagtttacgtaaacttaccttaaacctaaaaagtagaaaaacttaaaccccgttaggaaacggaaccggacccggaaaggaaccgaccgggacctaagttacggttaaacttacgtggttacgggtaggggtaccttaacgtttaccgtacgggaccccggttcggggggaccccggtaaaccctggtacccctacccggttcccaccccccgtacctacccggaaccgtaacccggg

SEQ ID NO: 418883 - DNA, 558 bp, Homo sapiens
  misc_feature: GZ8MTXP02JWMTR.21.78.H01.1.454.CMB.2.raw
  modified_base (479)..(479): a, c, t, g, unknown or other
  modified_base (487)..(487): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccaggctccgaggggaacggccgtggacgtggatcgtcactttatttatagtggtggtacccacatactacacagactccgtgaacgggccgattcacatctcaagaagacaattccaaggaacacattgtactacttacaaatgaaataacctgagagaccgagacacggcatgtatacgngtgtgggntacttacgtacgacccgtcgggggcccggaaccgtcggtccaccgtccacccaccctccgaccgtaaccgg

SEQ ID NO: 418884 - DNA, 588 bp, Homo sapiens
  misc_feature: GZ8MTXP02I274F.21.78.H01.1.454.CMB.2.raw
  modified_base (345)..(345): a, c, t, g, unknown or other
  modified_base (437)..(437): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtgggtccgccaggctccgaggggaaggcctggagtggatcgtctacttatttanagtggtggtacccactatactacacagactccggtagaacggggcctaattccaacccatcctacagaaacgactaaattcccaaggaaacncaatttgtatacttacaaatagaaataacctgagacgaccgagtacacggcctagtgtatactggtaggtgggctagtttactcgaccccggtgggggacccggaacctgggacccaccggtccctacccccaccgtccaccgaacccggg

SEQ ID NO: 418885 - DNA, 640 bp, Homo sapiens
  misc_feature: GZ8MTXP02HYOE6.21.78.H01.1.454.CMB.2.raw
  modified_base (368)..(368): a, c, t, g, unknown or other
  modified_base (377)..(377): a, c, t, g, unknown or other
  modified_base (538)..(538): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagcgtgggtccgccgaggcctccgaggggaacgggccgtggagtggatctcgtactttattagtagtggtaggtaccccanatactacanagctcgtgaaggccattcaccatctacagaaacgacaacttccgaaggaaacactaattcgtaatcttaacgtaaaatagtaaacttaaaccgtggaacgaacggaccgaaggaaccgaccgggaccaagttagtaactttaacgtggtaggtacggggtntaacgtttaccgtacggtaaccccggtcgggggtacccgggtaacccgtcggtaccctaacccggttccctacccccgtcccctaccgtacccgaacccggg

SEQ ID NO: 418886 - DNA, 643 bp, Homo sapiens
  misc_feature: GZ8MTXP02F54R4.21.78.H01.1.454.CMB.2.raw
  modified_base (363)..(363): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtggggtcccgccgaggctccgaggggaacgggcctggagtggatctctactttattatagtggtcgtacccanatactacacagactccgtagaagggccatccaacatcacaagaagacaaattcccgaagaaacactatagtactactacaaaatgaaaactaaccgtgaagacgacgaacgaacgacggaccaattggtaacttacgttggtaggtacgggggactttacgttttaaaccggtccggtacccccggttacgggggacccccgggggtaaacccgtcggggtacccctaacccggttcctaaccccccccgaccgttaccccgaacccgtaaaacccgggg

SEQ ID NO: 418887 - DNA, 591 bp, Homo sapiens
  misc_feature: GZ8MTXP02HJY6K.21.78.H01.1.454.CMB.2.raw
  modified_base (489)..(489): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagcgtggggtcccgccgaggcctccgaggggaacgggcctgggagtggatctctactttatttatagtggtggtaccccacatactacacagactccgtgaaagggccgattccaccatctacagaaagacaacttccaagaacacaattgtatctacaaatgaaactaactgagacgaccgagacacggcatgtattacgnggtgtggggactacgtttacgtcgtaccccgtcgggggacccgggtaacctcgggtcctaacccggtccctacccccacccctacccgaacccgaacccggg

SEQ ID NO: 418888 - DNA, 573 bp, Homo sapiens
  misc_feature: GZ8MTXP02JHOJZ.21.78.H01.1.454.CMB.2.raw
  modified_base (356)..(356): a, c, t, g, unknown or other
  modified_base (483)..(483): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaagggcctggagtggatctcactttattatagtggtggtaccccanatactacacagactccgtgaaacgggccgaattcacatctacagaaacgacaattccaaggaacacgattgtatctacaaaatgaaatacctgacgagaccgaggacacggccaagtgtaattacgngtggtggggactacgtttacgtacgaccccgtgggggcccgggaaccctggtcccaccggtccctccccaccctaccaccgtaacccggg

SEQ ID NO: 418889 - DNA, 663 bp, Homo sapiens
  misc_feature: GZ8MTXP02JJ84U.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgaggcctccgaaggggaacggggcctgggagtgggactctactactttatttataggtgggtacgtaaccccgactatactacacagactccggtagaacgggccgtataccaaccagtctacgaagaaacgactaattccgaagaaacactaatttcgtaattcttaacaaaagtcgtaaaataacccgtagaacggacggaaccgaaggaaccaccgggcctaagttcgttaattacgtggttcgggtggggtactaacgttttaccgttacggaacccccggttcggggggaccccgtaaccgtcggtacccaacccggttcccacccccgacccctacccgaccgtaaaccccgggg

SEQ ID NO: 418890 - DNA, 576 bp, Homo sapiens
  misc_feature: GZ8MTXP02GWBW4.21.78.H01.1.454.CMB.2.raw
  modified_base (297)..(297): a, c, t, g, unknown or other
  modified_base (373)..(373): a, c, t, g, unknown or other
  modified_base (469)..(469): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggttcagttggtggagactggaggaggcttgatccagcctggggggtccctgagactctcctgtgcagtctcgtgggttcgtcagtggcgactacatgagctgggtccnccaggctccgaggggaaggcctggagtggatctcactttatttatagtggtggtaccacatacacacacgactcgngaagggccgattcgacctatctacagaaacgacaattccgaaggaacacattgtatcttacaaatagaataacctgagacgcgagacacggcagtntattacgtgtgtggggtactatttacgtcggacccgttcgggggacccgggtaaccgtgggtcccgaccgtcccgtcccccacccgtccgacccgaacgggtccccg

SEQ ID NO: 418891 - DNA, 554 bp, Homo sapiens
  misc_feature: GZ8MTXP02JK3NN.21.78.H01.1.454.CMB.2.raw
  modified_base (389)..(389): a, c, t, g, unknown or other
  modified_base (395)..(395): a, c, t, g, unknown or other
  modified_base (420)..(420): a, c, t, g, unknown or other
  modified_base (455)..(455): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggttttccgtgttagctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggctccgagggaggctggagtggatctcacttattatagtggtgtacccacatactacacagactccgtgaacgggccatcacatcncagaanacaatccagacacattgtatactanaaatcgaaatacctgagagacgagacacggcattntactagtgtggtggactacgttacgtcggtacccgtcggggacccggtaaccgtcggtaccgtacccgtcccgtaccccacccgtacccgaccgaccgg

SEQ ID NO: 418892 - DNA, 594 bp, Homo sapiens
  misc_feature: GZ8MTXP02I9IVF.21.78.H01.1.454.CMB.2.raw
  modified_base (299)..(299): a, c, t, g, unknown or other
  modified_base (360)..(360): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccnccgaggctccgaggggaggcctggagtggatctctactttatttatgtggtcgtaccccanatactacacagactcggtagaacgggccgtattccaactatctacaagaaagactaaattcccaaggaaacactattgtaatcttacaaaatcgaaataacctgagagaccgagacacggcaagtgtaatacgtgtggtggggtactacgtttacgtcggaccccggtgggggaccccgggtaacctgggtaccctaccggtccctcccccgacccgtcccgaaccgaacccgg

SEQ ID NO: 418893 - DNA, 587 bp, Homo sapiens
  misc_feature: GZ8MTXP02JCJWS.21.78.H01.1.454.CMB.2.raw
  modified_base (303)..(303): a, c, t, g, unknown or other
  modified_base (348)..(348): a, c, t, g, unknown or other
  modified_base (365)..(365): a, c, t, g, unknown or other
  modified_base (431)..(431): a, c, t, g, unknown or other
  modified_base (446)..(446): a, c, t, g, unknown or other
  modified_base (452)..(452): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggtagttttggctgagctgggttttccttgttgctatttcaaaaggtgtccagtgtgaggtgcagttggtggagacgtgggaggaggcttgatccagccgtgggggtcctgagactctcctgtgcagtctcgtgggttcgtcagtggcgactacatgagcgtggggtccnccagggcctccgaggggacggcctggagtggatctcactttattntagtggtcgtaccccanatactacacagactcgtagaacgggccattccacctatctacagaaacacaattaccaagtaaccntattgtatcttaaanaaatanaaactacgtagagacgacgagacacgactatgtatcgtggtacggtcggacttacgtttacgtccggacccgggtacgggggacccggtaccgtcggtacccacccgtcccaccccaccctccgaaccgtaccgg

SEQ ID NO: 418894 - DNA, 904 bp, Homo sapiens
  misc_feature: GZ8MTXP02F28T5.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagtttggctgagctgggttttccttgttgctatttacaaaggtgtccagtgtgaggtgcagttggtggagactggaggaggcttgatccagccgtgggggtccctgagctctcctgtgcagtctcgtgggttcgtcgaggtggcgactacagtgagcgtcgggtccgccgaggcctaccggaggggaaacgggtccgtaggggtaggtgggtactcccgttactaacgttttaagtttaagtagggttaggggttacggtaacccccaacgtaacttaaaccttaaacgaaccgtaacggtaaccgtcccgggtaagggaaaccggggtacccgtaactttaccaaccctaacgttacctaacgaaacggtaaaacgaacctaaaacgtttaccccgaaaacggggtaaaacctaccttaaagttttacggttaaaccttaaccgtttaaactaaaaaaacgttacggtaaaaaacctttaaaaccccgggtaggaaaacgggtaaaccgggtaaccccggaaaaccgggaccggtaaccccgggaacccttaaaggttacgttaaacgttttaccgtagggtttacgggggttacgggggtaacctttaaacgtttttaacccggttacccggttaaaccccccgggggttaccgggggggtaccccccggggttaaaaccccgttccggggttaaccccgtaacccccggtttacccccgtacccccccgtaacccccgtacccccgtaaacccggtaaacccccgggg

SEQ ID NO: 418895 - DNA, 808 bp, Homo sapiens
  misc_feature: GZ8MTXP02G48OM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcaggctccgaggggaacggcctggagtggatctactactttattatggtggtgtaccccacatactacacaacgactccggtagaacggggtccgaactttcaaccctagttcctacaaaggaaacgtaacaaaactttacccgaaagggtaaaaccaacctaagtttacgtaaacttaccttaaacctaaaaattaggtaaaaaccttaaaacccgttaggaaacgtaaacgggaccccggaaacgggaaaccgaaccccggggtaaccctaagttacgggtttaaactttaaccggttcgggttaggggttacggggggtaccctttaaacgtttttaaaccccggtttaccgggtaaaccccccccggggtttacggggggggaaccccccgggggttaaaacccccggtttcgggggttaacccccgtaacccccgggtttaccccctacccccccccggtaacccccgttaccccccgaaaaccccggttaaaacccccggggg

SEQ ID NO: 418896 - DNA, 555 bp, Homo sapiens
  misc_feature: GZ8MTXP02GWIYF.21.78.H01.1.454.CMB.2.raw
  modified_base (458)..(458): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccgaggctccgagggaaggcctggagtggatctcacttattatagtggtgtacccacatactacacagactccgtgaacgggccgattccacatctacagaagacaatccagaacacattgtatcttacaaatgaaatactgagagccgagacacggcatntatactgtaggtggggactagtttactcgaccccggtcggggacccgggaacccgtggtaccacccggtcctcccccgaccctccaaccgaaccggg

SEQ ID NO: 418897 - DNA, 632 bp, Homo sapiens
  misc_feature: GZ8MTXP02G3PMN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtccgccgagggcctccgaaggggaacgggcctggagtggatctcgtactttatttataggtggtggtaccccacatactacacagactccgtagaacggccgattccactatcctacacgaagactaacttaccgaaggaaacacctattgtaacttaccttataaatagtaaactaaccgtgaagacggaccgaacggacacgggtaccagttacgtagtacgtggtaggtggggcttaacgtttcgtaccggtacccggtcgggggtacccggtaaccgtcggtaccccacccggttccctacccccgaccctcccgaacccggtaaccccgg

SEQ ID NO: 418898 - DNA, 753 bp, Homo sapiens
  misc_feature: GZ8MTXP02JYY87.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttctcagtggcgactacatgagcgtcgggtcccgccgaggctccggaggggacggcctggagtggactctctactttatttagtaggtggtacggtaccccactatactaacacagactccggtagaaacggggccctagttccaaccattcctacaagaaacggaacctaaacttacccgaaggtaaaccactaagtttacgtattacctttaacaaaattagtaaaactaacccgtaggaacggaacgggacccggaaagggaacccgaccggggacccctaaagttacggtttaagtttaaaccgttggggttacggggttacgggggttacttaaacggtttttacccggtttaccggaaccccccggggttacggggggtaacccccgggggtaaaccccgttcgggtacccccgttaaccccgggttcccctacccccccggtaacccccttaccccggtaaaccccggaaaccccgggg

SEQ ID NO: 418899 - DNA, 831 bp, Homo sapiens
  misc_feature: GZ8MTXP02HDD7O.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccaggccgtgggggtccctgagactctcctgtgcagtctcgtgggttctcgagtggcgactacatgagcgtcgggtcccgaccgacggcctaccggaggggaaacgggcccgtaggggacggtagggtacttcccgtacttaacttttaattttaaagtaggttcggggttacggtaacccccaacctaactttaacctacaaccgtaacgtacccgttcccggggtaagggaaacgggggtccctaacgtttacccaaacccgtactacccgtaccgaaagaaaacggaacctaaacgttacccgaaacggaaactaactagtttaacttaacttcttaaacctaaaattacgaaaacttaacccgttagggaaacgtaccgggaaccgggaaacggtaaccgaacccgggacctaagtttaaccggttatttaaaccgttggggttagggttacgggggtactttaaacggtttttaccgtacccggggttaacccccgggacggggggacccccgggttaaaccccgttccgggtaccccgtaaaccccgggttccccctaccccccgaaacccccgttacccggaaaccccggtaacccccgggg

SEQ ID NO: 418900 - DNA, 617 bp, Homo sapiens
  misc_feature: GZ8MTXP02H4IPA.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatcagccgtggggggtccctgagactctcctgtgcagtctcgtgggttcgtcagtggcgactacatgagcgtgggtccgccaggctccgagggaggcctggagtggatctcgacttatttataggtggtgtaccccacgatactacacagactccgtagaacgggccgattccaccatctacaagaaagacaaacttacccgaaggaaaccactattagtacttcttacaaaattgtaaactaaccgttgagaggccgaaggacacgggccagtacgtattacgtggtggtggggtactagtttaacgtcggtacccccgttggggggaccccgggtaacccgtggggtccccaacccggttcctacccccctacccgttccgaaacccgaacccgggg

SEQ ID NO: 418901 - DNA, 620 bp, Homo sapiens
  misc_feature: GZ8MTXP02IHV3G.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtcctgagactctcctgtgcagtctcgtgggttcgtcagtggcgactacatgagcgtcgggtccgccgaggcctccgaggggaacgggcctggagtggatcgtctaactttatttatagtggtgtaccccactatactacacagactccgtagaaggccgtattccacattcacagaaagacaattccaagaacactattgtatcttaacaaatagaaataactgaagacgaccgagacacggacctagtagttattacgtggttggtacggggtctaacgttttacgttaccggtaacccccggtcgggggaccccgggtaacccgtcgggttacccacccggttccctacccccgaccccttacccgaaccgaaccccgggg

SEQ ID NO: 418902 - DNA, 597 bp, Homo sapiens
  misc_feature: GZ8MTXP02F6ZQ9.21.78.H01.1.454.CMB.2.raw
  modified_base (445)..(445): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtaccgccaggctccgaggggaacggcctggagtggatctcacgttatttatagtggtgtacccacatactacacacgactccgtagaacggggcctacttcaccatcctacagaaagacaattccaaggaacactattgtatcttaanaaatagaactacgagagacgacgaagacgacgactatagtacgtacgtgtcggtacggtacttacgtttacgtaccggtacccgggtacggggacccgggtaccgtcggtacccacccgtccctacccccgacccgtacccgaccggaacgg

SEQ ID NO: 418903 - DNA, 677 bp, Homo sapiens
  misc_feature: GZ8MTXP02JHNIF.21.78.H01.1.454.CMB.2.raw
  modified_base (275)..(275): a, c, t, g, unknown or other
  modified_base (288)..(288): a, c, t, g, unknown or other
  modified_base (302)..(302): a, c, t, g, unknown or other
  modified_base (308)..(308): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtggttttccgtgttaggctatttacaaaaggtgtccagtgtgaggtgcagttggtggagactggaggaggcttgatccgagccgtgggggtccctgagactctcctgtgcagtctcgtgggttcgtnagtggcgactaangtgagcgtcggccncgagcncggagggacggcgtggagtgactctactatttagttagtaggtcggtacgtacccactactactacacgacgtaccgtccggtaagggaaacgggtcctacttaccaacctactaccgtaaagaacgaaacgtaacgtaaacgtaccgaacgaaactaactaacgttacgttaacttacttaactaaataacgtaaacgtaacgtacgagacgaccgacggaacgacgacgtacgtagttacgtacgtaggtcggtacggtacgttacgtttacgttaccggtacccgggtaccggggtacccgggtacccggtaaccggtaccgtacccgtaccccgtaccccgtacccgtacccgtacccgacccgg

SEQ ID NO: 418904 - DNA, 554 bp, Homo sapiens
  misc_feature: GZ8MTXP02GU789.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtcccgccagggctccgaggggaagggcctggagtggatctcactttatttatagtggtggtaccccacatactacacagactccgtgaacgggccattcaccatctcagaaagacaattccaagaacacattgtatctacaaatgaaatacctagagagccgaggacacggccatgtattacgtgtgtggggctagtttactcgaccccgtggggacccgggaacccgtggtccaccgtcctccccacctccacctaacggg

SEQ ID NO: 418905 - DNA, 814 bp, Homo sapiens
  misc_feature: GZ8MTXP02G4DUR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtcctgagactctcctgtgcagtctcgtgggttcgtcaggtggcgactacatgagcgtgggtccgccgaggcctccggaggggaacggggcccgtaggaggtgggactccgttactaactttatttaagtaggttgggtacggtaaccccactataacctaaccaacaacgtacctccgggtagggaaacggggtcccgtattacccaacctattaccctacaagtaaaacgaaactaaacgttacccgaaacggtaaaaccaacctaagtttacgttaaactttacctttaaactaaaaaccgttaggtaaaaacttaaaccccgttaggaaaggaaccgggaacccgggaaacgggaacccgaaaccggggtaacccctaaagttacgggtttaaactttaaaccgttggggttaacggggttacgggggtacctttaaacgttttaacccggttacccgggtaccccccggggtacggggggtacccccgggggtaaccccgttcggggtaccccgtaccccggttaccccctacccccgaccccctaacccccgaacccggtaaacccccgggg

SEQ ID NO: 418906 - DNA, 602 bp, Homo sapiens
  misc_feature: GZ8MTXP02IFBGF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtggttcgtcagtggcgactacatgagcgtggggtcccgccgaggcctccggaaggggaaggccgtggagtggatctctacttattatagtggtgtaccccactatactacacacgactccggtagaacggggcctattccactatctacagaaacgaactaacttccgaagaaccaactattagtatacttacaaaatgaaactaaccgtgaagacggaccgagacgacggaccatagtatacgtgtggtgggctatttacgtcggacccggtcgggggtacccgggtaaccgtcggtaccacccggtcccacccccgtacccgtcccaaccgtaacccgg

SEQ ID NO: 418907 - DNA, 595 bp, Homo sapiens
  misc_feature: GZ8MTXP02JZUZS.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcacttatttatagtggtggtaccccacatactacacagactccgtgaacgggccattcaccatctacaagaagacaattccaagaacacattgtatcttacaaatgaaataacctgaagacgaccgaggacacggcatgtattacgtgtggtggggtctacgtttacgttcggtacccccggtcgggggaccccggggtaacccgtcgggtaccgtaccccggtccctaccccccgtaccccgtaccccgaacccgtaacccgggg

SEQ ID NO: 418908 - DNA, 571 bp, Homo sapiens
  misc_feature: GZ8MTXP02G62SY.21.78.H01.1.454.CMB.2.raw
  modified_base (299)..(299): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccnccaggctccgaggggaggcctggagtggatctctactttattataggtggtggtacccacatactacacagactcgtagaagggccgattccacatctacagaaagacaattcccgaagaaccaacattagtatacttacaaatgaaataacctgagagaccgaagacacggcatgtatactggtgtgggatactttcgtacgccccgtaggggacccggggtaaccctggtacccacccgtcctcccccaccgtcccaaccgtaacccggg

SEQ ID NO: 418909 - DNA, 608 bp, Homo sapiens
  misc_feature: GZ8MTXP02HB4E1.21.78.H01.1.454.CMB.2.raw
  modified_base (398)..(398): a, c, t, g, unknown or other
  modified_base (402)..(402): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgaggggaacggccgtggagtggatcgtctactttatttatagtggtgtaccccacatactacacagactccgtgaagggccattcacntcanagaagacaatccaagacacattgtatctacaaatgaaataaccgtgagacgaccgaagacacggcagtgtaagttactggtacggtggggtactacgtttaccgtaccggtacccccgggtcgggggaccccggggtaacccgtcgggtaccccgtacccggttacccctcccccgtacccctaccccgaacccgtaaccccgggg

SEQ ID NO: 418910 - DNA, 580 bp, Homo sapiens
  misc_feature: GZ8MTXP02I49LN.21.78.H01.1.454.CMB.2.raw
  modified_base (357)..(357): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgaggggaaggcctggagtggatctcactttattatagtggtggtaccccanatactacacagactccgtgaacgggccgattcaccatctacagaagacaattcccaagaacactattgtatactacaaatgaaactaacctagagagaccgagacacggacatcgtatacgtgtggtaggggctactttacgtcgaccccgtgggggaccccgggtaaacccgtggtacccgacccggtaccctacccccgaccctccgaacccgaacccggg

SEQ ID NO: 418911 - DNA, 591 bp, Homo sapiens
  misc_feature: GZ8MTXP02I9FIS.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgtaggaggcttgatccagcctggggggtccctgagactctcctgtgcagtctctgggttcgtcagtggcgactacatgagctggggtcccgccaggctccgaggggaagggcctggagtggatcgtctactttatttatagtggtggtaccccacatactacacagactccggtgaacggggccattccacatctcagaagacaacttccagaaacactattgtatcttacaaattgaaataacctgagagccgaggacacggccagtcgttatacgtgtacggtggggactacgtttacttaccggtacccgtcgggggacccggggtaacccgtggtacccgacccgttcctacccccgacccttcccgaaccgaacccggg

SEQ ID NO: 418912 - DNA, 818 bp, Homo sapiens
  misc_feature: GZ8MTXP02I0N4I.21.78.H01.1.454.CMB.2.raw
  modified_base (646)..(646): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccaggccgtgggggtccctgagactctcctgtgcagtctcgtgggttcgtcgagtggcgactacatgagcgtcgggtccgccgaggcctccggaaggggaaacggggcccgtagggaggtgggaacttcctacgtaactttaagtttaagtaggtgggttacggtaacccccaactaacttaaccgtaacacgaaacgacctcccggttagggaaacggggacccgtaatttacccaacctaacttccgtaaacgaaacgaaaagtaaaccctaaacgtttacccgaaagggtaaaacctaacctaagtttacgttaaacttaccttaaacgtaaaaaatgtaaaacttaaacccgtaggaacgaacgggaccggaaacggaacccgaaaccgggacctaaagttagtttaaactttaccggnggttacggggtacggggtaccttaacgtttttaaaccgttcccgggtaccccccggggttacggggggtacccccgggggtaaaaccccgtttggggtaacccccgtaacccggttacccccccttaccccccgaacccccgttacccccgaaacccggaaaacccccgggg

SEQ ID NO: 418913 - DNA, 769 bp, Homo sapiens
  misc_feature: GZ8MTXP02IUQHB.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtcgggtccgccgaggcctccgaggggaacgggcccgtggagtggatctctactttatttatagtggtggtacccacatactacacacgactccggtagaacgggccattccaaccatcctacaagaaagactaaacttccgaaacggaaaacacctaagtttacgttaacttactttaacaaaattagtaaaacttaaacccgttagaaacggaacgggacccggaaacgggaacccgaaccggggaccctaaaagtttcgttaaacgtttaaacccgttagggttcgggttcgggggtaacccttaacgtttttaaaccggttacccgggttaaccccccggggttacggggggggtaacccccgggggttaaaaccccggttccgggggttacccccgtaaacccccggggtttcccctaccccccccgtaaaccccccggttacccctaaaacccccgggtaaaacccccggggg

SEQ ID NO: 418914 - DNA, 761 bp, Homo sapiens
  misc_feature: GZ8MTXP02IKFNY.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtcgggtccgccgaggcctaccgaggggaacggccgtaggaggtggacttcgtactaacttttaatttaagtaggttgggttacggtaaccccctaaactaactaactaaacaaccgaacgtaaccgttcccgggttaagggaaaacggggtccccgtaaactttacccaaaccctaacttccctaccaaaggaaaacgaaacctaaacttacccgaaaggtaaacaacctaatttagtaacttacttaaacaaaattagaaaacttaaaccgtgaaacgacgaccggaaaggaccaaccgggacctaagttaggtaactttacgtaggttagggtacgggggtacttaaacgtttaccgttaccggtacccccggggtaccgggggaaccccgggggttaaacccgtcgggtacctaccccggttaccccctacccccgacccccgttacccgaaacccggaaaccccggg

SEQ ID NO: 418915 - DNA, 720 bp, Homo sapiens
  misc_feature: GZ8MTXP02H11HK.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtcctgagactctcctgtgcagtctcgttgggttcgtcgaggtggcgactacatgagcgtcggggtcccgccgagggcctaccgaggggaacgggcctgggagtggatctctactttattagtagtggtacggtacccactactaactacacgagtacctccggtagaaacgggcccgaattccaccatcctaccgaagaaacgaactaaacttacccgaaaggtaaacctaacctagtttagtaacttaccttaactaaaagttacggtaaaacttaaaccgtagtaaggaacggacccggaaacgggaccaacgggtacccaagttacgttaattaaaccgttgggtaggttacgggggtaccttaacgttttaaccgttaccgggtacccccgggttacggggggaccccggggtaacccgtcggggtaccctacccggtccccgtacccccaaccccgtacccctaacccggaacccggg

SEQ ID NO: 418916 - DNA, 605 bp, Homo sapiens
  misc_feature: GZ8MTXP02GWVNG.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccgaggcctccgaggggaacgggcctggagtggatcgtcactttatttatagtggtggtaccccacatactacacagacctccggtgaaacggggccgtattccaaccatctacagaaagacaattcccaaggaaacacaattgtatacttacaaatgaaataaccgtagagacgacgaggacacggcatgtattacgtgtacggtggggacttacgtttacgtcggacccgttcgggggaccccggggtaaccctcgggtccaacccgttcctacccccgacccgtacccaacccgtaacccgggg

SEQ ID NO: 418917 - DNA, 656 bp, Homo sapiens
  misc_feature: GZ8MTXP02FOPYY.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaagggcctggagtggatctctacgtttatttagtagtggtggtaacccccatatactacacagtactccggtagaaacggggccgtattccaacccatcctaccaagaaacgacaaattcccaaggaaacaactattagtattacttacaaaatagaaataaacctagtagaacggaccgaacggaacgacggacctagtagtaacttacgtggtacggtgggggtacttaacgttttacgttaccggtacccccggttacgggggacccggggtaaaccccgtcgggtacccgtaaccccgttccctccccccgaccccgtacccaacccgtaaacccggg

SEQ ID NO: 418918 - DNA, 632 bp, Homo sapiens
  misc_feature: GZ8MTXP02HMT5E.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccgaggcctccgaggggaaggcctggacgtggatcgtcactttattataggtggtggtaccccacatactacacagactccggtagaacgggccattccacatctacagaacgacaaacttccgaagaaacacatttagtatacttacaaatgtaaataaccgtagacgagccgaagacacggccatacgtattacgtaggtggtcgggggtactaacgtttaccgtttacggaccccgggttacgggggaccccgggggtaaaccccgtcgggtaccctaacccgggttccctacccccggtaccccctacccgtaaccccgaaaccccgggg

SEQ ID NO: 418919 - DNA, 578 bp, Homo sapiens
  misc_feature: GZ8MTXP02GOXS9.21.78.H01.1.454.CMB.2.raw
  modified_base (483)..(483): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccgaggctccgaggggaagggcctggagtggatctcactttatttatagtggtggtaccccacatactacacagactccgtgaaggccgattcacatctcagaaagacaattccaaaggtaacacattgtaactcttacaaaatgaaattaaccctgagagaccgaggacacggccatgtattacgngtaggtgggattactttacgtcggaccctcggggggacccggaaaccctggtcccaaccggtcctacccccgaccctcccgaaccgaaacccggg

SEQ ID NO: 418920 - DNA, 580 bp, Homo sapiens
  misc_feature: GZ8MTXP02GAKL7.21.78.H01.1.454.CMB.2.raw
  modified_base (401)..(401): a, c, t, g, unknown or other
  modified_base (438)..(438): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgaggctccgagggagggcctgggagtggatcgtctactttatttatagtggtgtaccccacatactacacagactccgtgaacggccgattcacatcanagaagacaatccgagaacacattagtatctacaaatnaaatactgagagcgaaggcacggcatacgtatactggtagtggggtactacgtttacgtcggtaccccgtcgggggacccgggtaacccgtggtacccgtacccggttccctacccccgaccctacccgaccgtaacccggg

SEQ ID NO: 418921 - DNA, 638 bp, Homo sapiens
  misc_feature: GZ8MTXP02I37M3.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgagggaaggcctggagtggatcgtctacttattatagtggtcgtacccacatactacacagactccgtagaacgggccgattcactatctacagaaacgacaacttccaaaggaacacgtattagtacttacttacaaaatagtaaataacccttggaacgaggaccggaagacgacggacctatgtaattacgtggtacggtggggacctagtttacgttcggtacccccggttaggggggacccccgggggtaacccttcggggtacccgtacccgggtttaccccctacccccgacccccgttcccgaaacccgtaaaaccccggggg

SEQ ID NO: 418922 - DNA, 607 bp, Homo sapiens
  misc_feature: GZ8MTXP02H9JO9.21.78.H01.1.454.CMB.2.raw
  modified_base (499)..(499): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcggggtccgccgaggcctaccgaggggaacggccgtggagtgggatctctactttattagtagtggtggtacccacatactacacagactccgtagaacgggccagttccaccatcctacaagaaagacaaacttccgaagaacaactattagtatacttacaaaatgaaatactagagagccgagacacggcatgtatactgtggngggctactttacgtcgaacccccggtgggggtacccggggtaacccgtcggggtacccacccggttaccctaccccccgaacccgttcccgaaaccgtaaccccgggg

SEQ ID NO: 418923 - DNA, 592 bp, Homo sapiens
  misc_feature: GZ8MTXP02G0T2R.21.78.H01.1.454.CMB.2.raw
  modified_base (357)..(357): a, c, t, g, unknown or other
  modified_base (483)..(483): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggctccgaggggacggcctggagtggatctctacttattatgtggtgtacccanatactacacagactccgtgacgggccattccacatcacagaacacaattccaagaacactattagtatctttaacaaatcgaaataacctgacgacggaccgaaggaccacggcagtgtattacgnggtggtagggctacgtttcgtaccggtaccccggtcgggggaccccggtaaccgtcggtacccgacccggttccctaccccccgaccctacccgaacccgtaacccggg

SEQ ID NO: 418924 - DNA, 572 bp, Homo sapiens
  misc_feature: GZ8MTXP02JU3MK.21.78.H01.1.454.CMB.2.raw
  modified_base (475)..(475): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaggcctggagtggatctcactttatttatagtggtaggtaccccacatactacacagactccgtagaacggccgatcaccatcacagaagacaattcccaaggaacacattgatcttacaaatgaaatacctgagagccgaggaccacgggaccagtgtattacngttggtggggctagtttacttcggaccccgtcgggggcccgggtaacctcgggtaccctacccgtcctacccccacccgtacccaccgtaacccggg

SEQ ID NO: 418925 - DNA, 586 bp, Homo sapiens
  misc_feature: GZ8MTXP02FPK20.21.78.H01.1.454.CMB.2.raw
  modified_base (362)..(362): a, c, t, g, unknown or other
  modified_base (448)..(448): a, c, t, g, unknown or other
tcagtcgtcgctcgcacgaccggtgctcgatttagtgtgagtagtttgggtttggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgaggggaaggcctggagtggatcgtctactttatttatagtggtggtaccccanatactacacagactcgtagaacggccattcacatctcagaacgacaacttccaaggaacactattgtatactacaaatgaaatacngagacgacgagacacgctatgtatacgtgtggtaggggtactactttaacgtcggaccccggttcgggggacccgggtaaacccgtggtcccgtacccgtcccgttacccccacccgtcccgaacccgtaacccgggg

SEQ ID NO: 418926 - DNA, 636 bp, Homo sapiens
  misc_feature: GZ8MTXP02H7MLK.21.78.H01.1.454.CMB.2.raw
  modified_base (304)..(304): a, c, t, g, unknown or other
  modified_base (450)..(450): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgttgggttcgtcaggtggcgactacagtgagcgtcggggtccncccgaggcctccggaggggaacggggcccgtgggaggtgggactctctacttatttataggtggtcggtaccccactatacacacagacctccgtaggaacggccgtattccaccatcctacaagaaagacaattccgaagaacanacttagtacttcttaacaaatagtaaactaaccgtagagacgacgaagacacggcatacgtattacgtgtggtgggtctactttacgtaccggtaccccggtcgggggaccccggggtaacccgttcggggtaccctaccccggttaccctaccccccacccgttaccccacccggaaaccccggg

SEQ ID NO: 418927 - DNA, 804 bp, Homo sapiens
  misc_feature: GZ8MTXP02F4FQP.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagtttggctgagtctgggttttccttgttgctatttacaaaggtgtccagtgtgaggtgctaggttggtggagacgtgggaggaggtcttgactccgacggtccggtcgggggtccctggacgtactctccgtgtcgctagttcttcgtgggttcgtcgaggtcggacgactacgagtgacgtccgtcgggcccgccggacgggccgtaccgggaaggggaacggtccgtagggaggtaggtacttaccttaccttagttttaatttagtaggtcggtacgtaaccccactaactactaacaacgtacgacgtccggagaacgggtcctacttaccaactactactaacgaaagtaaactaccctaaaacttacccgaaagtaaaccctaagttatttaactacttaaacccgtaaagtaaaactaacggtaaaaccttaaccgagggaaaacgtacccgggaaaccggttaacggaaccgaacggttacctaaagtttacggtttaaattcggtgggttacggggttacgggttacctttaaaaccggttttcccgtaacccggggacccccggggtttaccggggggaaccccggtttaacccgtcccggtaccccctaccccgtaccccctaaccccggtaccccgaacccggtaacccgtaacccg

SEQ ID NO: 418928 - DNA, 600 bp, Homo sapiens
  misc_feature: GZ8MTXP02JDXS2.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggctccgaggggaacggcctggagtggatcgtctacttattatagtggtgtaccccacatactacacagactccgtgaacgggccgatccacatctacaagaagacaattccaaggaacactattagtatactacaaaatgaaactaacctagagacgaccgaggacacggccagtacgtatagtggtagtcggggctaacgtttacgtacgtaccccggtcgggggtacccggggtaaacccgtcggtcccgaacccgtaccctacccccacccgttacccaaccgtaaacccggg

SEQ ID NO: 418929 - DNA, 626 bp, Homo sapiens
  misc_feature: GZ8MTXP02H9EUF.21.78.H01.1.454.CMB.2.raw
  modified_base (390)..(390): a, c, t, g, unknown or other
  modified_base (410)..(410): a, c, t, g, unknown or other
  modified_base (415)..(415): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggagggaggcttgatccagccgtgggggtccctgagactctcctgtgcagtctcgttgggttcgtcgagtggcgactacatgagcgtcgggtccgccgaggcctaccggaggggaacggccgtggagtggatcgtctacttatttagtagtggtcgtacccactatactacacagactcgnggaacggccgatcacatcanagaanacaactaccaagaacacgtatttgacttctaacaaagtcgtaaaactaacgtgaacgacgaccggaagaccgacggcctagttacgttaattacgtggtaggtggggtactacttttaccggtaccggtaccccgggtcgggggacccggaacccttcgggacccgtacccgttcccgtacccccacccccgttacgaacccgtaacccgg

SEQ ID NO: 418930 - DNA, 647 bp, Homo sapiens
  misc_feature: GZ8MTXP02JXADT.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgtagttggtggagactggaggaggcttgatccagccgtggggggtccctgagactctcctgtgcagtctcgtgggttcgtcagtggcgactacatgagcgtgggtccgccaggctccgaggggaacgggccgtgggagtggactctctactttatttagttgtggtcggtaccactatactacacagactcgtgaagggccgtattccacatctacagaagacaatccaagaacacattgtatactacaaatgaaactaactgaagacgccgaagacgacggactaagtgttaacttagtcggtggttacggggtactagttttaacctccgggtaaacccccggttcggggggtaccccggggtaaccccggttcgggtaaccccgtaccccggttaccccgtacccccccgaacccccgttaccccgaaaccccggtaacccgggtacccccg

SEQ ID NO: 418931 - DNA, 579 bp, Homo sapiens
  misc_feature: GZ8MTXP02FY8IK.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtcccgccgaggctccgaggggagggcctggagtggactctctactttatttagtagtggtcggtaccccactatactacacacgctccgtagaaacgggccattcacatctacagaagactaacttacaagaacactattagtattactaacaaaatagaaactaactagagacgaccgagacgacgctatagtatacgtgtaggtgggactacgtttacgtcgacccggtcggggacccgggaccgtcggccaccgtccctccccgacctaccgaccaaccgg

SEQ ID NO: 418932 - DNA, 567 bp, Homo sapiens
  misc_feature: GZ8MTXP02F860O.21.78.H01.1.454.CMB.2.raw
  modified_base (452)..(452): a, c, t, g, unknown or other
  modified_base (480)..(480): a, c, t, g, unknown or other
  modified_base (489)..(489): a, c, t, g, unknown or other
  modified_base (542)..(542): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaacggcctggagtggatctcactttattatagtggtggtacccacatactacacagactcgtgaacgggcgattcacatctacagaaacgacaattccaaggtaacactattagtatacttacaaatgaaactaccngagacgcgagacacggcatgtattacgngtgtcgggntactttacgtcgaccccgtgggggcccggtaaccgtcggtaccacccggtccncccccacctcccaaccgtaacccgg

SEQ ID NO: 418933 - DNA, 602 bp, Homo sapiens
  misc_feature: GZ8MTXP02ILVGL.21.78.H01.1.454.CMB.2.raw
  modified_base (300)..(300): a, c, t, g, unknown or other
  modified_base (498)..(498): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtcctgagactctcctgtgcagtctcgtgggttcgtcagtggcgactacatgagcgtcgggtccnccgaggctccgagggaacggcctggagtggactcgtatactttatttataggtggtacggtacccactactactacacacgactccggtagaacgggccgattccgacctatctacaagaaacgaacaacttccaaagaacactaattgtaatactacaaaattagaaataacctagagacgacgagacacggcagtntatactgtggtcggtactagtttacgcggtacccggtacggggacccggtaacccgtggtcccgaccggtccctaccccgtaccctacccgaaccgtaacccgg

SEQ ID NO: 418934 - DNA, 642 bp, Homo sapiens
  misc_feature: GZ8MTXP02GXIRZ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggggttcgtcagtggcgaactacatgagcgtcgggtcccgccgaggcctccgaggggaacggggcctgggagtgggatctcactttatttagtaggtggtacggtaccccactatactacacagactccgtaggaaacgggccgtattccactatctacaagaaagacaaattccaagaaacactattgtatactacaaatgaaactactgagagaccgagacgacggacagtgtagtactggtcggtacgggtcttaagtttaccgttaccggtaccccggtacggggggacccccggggttaaacccgtcgggtaccccgaaccccggttcccctaccccccgtaacccccgtacccgtaaccccggaaaccccgggg

SEQ ID NO: 418935 - DNA, 707 bp, Homo sapiens
  misc_feature: GZ8MTXP02JD8BR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcaggtggcgactacatgagcgtcgggtcccgccaggcctccggaaggggaacggccgtgggagtggactcgtctaactttatttataggtggtacgtaccccactataactacacacgctcgtggaacgggccgtataccaccactctacaagaaacgactaaacttaccgaacgtaaacacgtaatttgtaacttacttaacaaaattagtaaaacttaacccgtaggaacgacgggaaccgaacgggaacccaaccggggacccttaaagttagttaactttacgtaggttacgggtcggggttacttaacgtttttaccggtaccggttacccccggggtacgggggtaccccgggttaaacccgtcgggttaccctaccccgggttacccttaccccccaccccggtacccgtaaaacccgtaaccccgggg

SEQ ID NO: 418936 - DNA, 648 bp, Homo sapiens
  misc_feature: GZ8MTXP02HK683.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccgccgaggcctaccgaaggggacggcctgggagtggactctctactttatttagtaggtggtacgtaccccactatactacacagacgtccggtagaacggccgtattccacatccacgaagaaacgactaaattccgaaaggaaaccactatttacgtattaccttaacaaaatgtaaaactaaccttagaacggacgacccggaggaaccacggcctagtagttattacgtggttcggtagggactttaacgtttaccgtcggtacccccggtgggggtaaccccggtacccgtggtacccgaaccccgttccctaccccccgtaccctaccgaacccggtaaccccgg

SEQ ID NO: 418937 - DNA, 632 bp, Homo sapiens
  misc_feature: GZ8MTXP02GMJZV.21.78.H01.1.454.CMB.2.raw
  modified_base (404)..(404): a, c, t, g, unknown or other
  modified_base (409)..(409): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccaggcctccgaggggaacgggccgtggaggtggatctcactttatttataggtggtggtaccccacatactacacagactccgtgaacggccatcacatcanagaanacaatccaagaacactattagtatcttaacaaaattgaaaatacctagacgagccgaaaggacgacggacagttagtaaatttcgtggtagggtggggacttaacgttttaccgtacgggtacccccggttacggggggaccccgggggttaaaccctcggggtaccctaaccccgggttcccccaccccccgaccccgtaccccgaaaccgtaaacccgggg

SEQ ID NO: 418938 - DNA, 547 bp, Homo sapiens
  misc_feature: GZ8MTXP02IWTCK.21.78.H01.1.454.CMB.2.raw
  modified_base (358)..(358): a, c, t, g, unknown or other
  modified_base (401)..(401): a, c, t, g, unknown or other
  modified_base (475)..(475): a, c, t, g, unknown or other
  modified_base (479)..(479): a, c, t, g, unknown or other
  modified_base (525)..(525): a, c, t, g, unknown or other
tcagtcgtcgctcgcacgaccggtgctcgatttagtgtgagtagtttgggtttggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaaggcctggagtggatctcactttatttatagtggtcggtacccanatactacacagactccgtgaaggccgattcacatctacagaanacaattccgaagaacacattgatctacaaatgaaactaacctgagacgaccgagacacggccaatcgtattacngtgngggctattactgaccccgtggggacccggaacctggtccacgtccnccccacctccaaccgtaaccgg

SEQ ID NO: 418939 - DNA, 594 bp, Homo sapiens
  misc_feature: GZ8MTXP02GL8HL.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggcctccgaggggaacgggcctggagtggatctctactttatttataggtggtggtaccccacatactacacagactccgtagaacggggccgattccacatctacaagaaagacaacttaccaagaacactattagtatacttacaaatgaaataactagagagcgagacacggcatgtattacgtgtggtggggctacgtttacgtcgtaccccggtcgggggacccggggtaacccgtgggtacccacccggtccctacccccgaccctacccgacccgtaacccggg

SEQ ID NO: 418940 - DNA, 785 bp, Homo sapiens
  misc_feature: GZ8MTXP02IJTNX.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagacgtgggaggaggcttgatccagccgtgggggtccctgagactctcctgtgcagtctcgtgggttcgtcaggtggcgactacatgagcgtgggtcccgccgaggctccgaggggaacggccgtgggagtgggacttctacgtaactttatttaagtaggtggtcggtaaccccacgtactaactacacgaacgactccggtaggaaacgggccgtattaccaccatcctacagaaaacgacaaacttcccgaaaggaaactaactatttacgtaaactttaccttaacaaaagttacgtaaaacttaaaccgtttaggaaaggtaacgggacccggaaacgggaaaccgaccgggtaaccctaagttaggttaaacgtttacgtcggggttaacgggtacgggggttaacttaacggtttttaacccggttaccgggtaaacccccccggggtttcgggggggtaaacccccgggggttaacccccgttaacgggggtttaccccgtaacccccggggttccccctaaaccccccccgtaacccccgttaccccggaaaaccccggtaaacccccggggg

SEQ ID NO: 418941 - DNA, 674 bp, Homo sapiens
  misc_feature: GZ8MTXP02GY500.21.78.H01.1.454.CMB.2.raw
  modified_base (300)..(300): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccnccaggctccgaggggaggcctggagtggatctctactttattagtagtggtacgtaccccacatactacacagactcggtgaaacgggccgattccacctattccacaaaggaaactaaactaacttacccgaagaaaccactattagtacttacttaacaaaattcgaaaacttaccgtaggaacgacggaccgaaaggaccaacgggacctaaagtggttaacttaagtggttcgggtagggggtaccttagttttaaccggttacggacccccgggttaggggggcccccggggtaaacccgttggggtacccctaaccccggttcccggtaccccccaaccccgtttacccgaacccggtaaaccccggg

SEQ ID NO: 418942 - DNA, 598 bp, Homo sapiens
  misc_feature: GZ8MTXP02GAZJB.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctcgggtccgccaggctccgagggacggcctggagtggatcgtcactttattatagtggtggtacccacatactacacacgactccgtagaacggccgattccacatctacaagaaacgacaaattccaaaggaaaccacgtatttagtatacttacaaaatgaaataacctgagacgccgaaggacacggactagtgtaatacgtgtggtagggactacgtttacgtacggaccccggttcgggggacccggggtaaccctggtacccaccgttccctacccccgtacctacccgaaccgaacccgg

SEQ ID NO: 418943 - DNA, 600 bp, Homo sapiens
  misc_feature: GZ8MTXP02HUP92.21.78.H01.1.454.CMB.2.raw
  modified_base (368)..(368): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagctgggtccgccaggctccgaggggaaggcctggagtggatctctactttatttatagtggtgtacccactatactacanagactccggtgaaagggccgattccacatctacaagaagacaacttccgaagaacacgtattgtaatcttaacaaatgaaataacctgagacgcgagacgacgcaatgtaattacgtgttcggtcgggtctacgttttacgtccggaccccggtcgggggtacccggggaaccccgtgggtaccgtaacccgttccctacccccgtaaccctccccgaaacccgaccccggg

SEQ ID NO: 418944 - DNA, 584 bp, Homo sapiens
  misc_feature: GZ8MTXP02HBIOF.21.78.H01.1.454.CMB.2.raw
  modified_base (395)..(395): a, c, t, g, unknown or other
  modified_base (401)..(401): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttctcagtggcgactacatgagcgtgggtccgccaggcctccgaggggaaggggcctggagtggatcgtcacttatttatagtggtggtacccacatacacacagactcgtgaacgggccgattcacatcncagaanacaatccagaacacattgtatcttacaaatgtaaataacctgaagcgacgacgacacggcagttcgtatacgtggtggtggggacttagtttaccgtcggacccccggttcgggggacccggggtaaaccctggggtaccctacccggtccctacccccgaccctcccaacccggaacccggg

SEQ ID NO: 418945 - DNA, 639 bp, Homo sapiens
  misc_feature: GZ8MTXP02I5IUV.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccaggctccgagggacgggcctggagtggatctcacttatttatagtggtgtacccacatactacacagactccgtagaagggccgtattcaccatctacaagaaagacaaacttccaaggaaacacctattgtatcttaacaaaattgaaacttaacctaggaagacggacccgaaggaccgaacgggacctaagttacgttaatttaacgtggttaggtagggggtctaacgttttaaccgtcggaacccccgttcggggggacccccgggtaaacccgtcgggggtacccaccccggttaccctccccccgacccgtaccccgaacccgaaacccgggg

SEQ ID NO: 418946 - DNA, 762 bp, Homo sapiens
  misc_feature: GZ8MTXP02FWPYU.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcagcatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggcctccgaggggacggcctggagtggatctctacttatttagtaggtggtcgtacccactactactaacacgaagccgtaccgtaggaaacggggcccgtattccgaacctaattccgtacgaacgaaacgaacctaaatttcccgaaaggtaaacctaactaacgtttacgtaattacctttaaacgaaaacttcgaaaacgttaaacccgtggaaaggtaaccgggaaccggaacgggtaaccaaccgggggtaaccctaagtacggggttaaactttacccggtaagggttcgggttaggggggtacctttaaacgtttttacccggttaccgggttaaaccccccgggtggggggttaacccccgggggaaaaccccgtttcgggggtaaccccgtacccccggggttaccccttacccccccgaacccccggtttacccccgtaaaacccccgggg

SEQ ID NO: 418947 - DNA, 565 bp, Homo sapiens
  misc_feature: GZ8MTXP02FRJN8.21.78.H01.1.454.CMB.2.raw
  modified_base (473)..(473): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcactttatttatagtggtggtaccccacatactacacagactccgtgaagggccgattcaccatctcagaaagacaaattccaagaacacattgtatctacaaaatgaaatacctgagagccgaggacacggcatgtattacngtgtaggggctagtttacttcggaccccgtcgggggcccgggtaacccgtggtaccgacccgtcctacccccgaccctcccgaccaaccggg

SEQ ID NO: 418948 - DNA, 553 bp, Homo sapiens
  misc_feature: GZ8MTXP02JDQCK.21.78.H01.1.454.CMB.2.raw
  modified_base (479)..(479): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccaggggaaggggcctggagtggatctcactttatttatagtggtggtaccccacatactacacagactccgtgaagggccattcacatctcagagacaattccagaacacattgtatcttcaaaatgaaataacctgaagagaccgagaccacggccatgtatactgtagtggggntactttactcgaccccgtgggggcccggggaaccctggtccacccggtcctccccgaccctccacgtaaccggg

SEQ ID NO: 418949 - DNA, 644 bp, Homo sapiens
  misc_feature: GZ8MTXP02GVUQ0.21.78.H01.1.454.CMB.2.raw
  modified_base (490)..(490): a, c, t, g, unknown or other
  modified_base (615)..(615): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtgaggtggcgactacagtgagcgtcgggtccgccaggcctccgaaggggaaggcgtggagtggatcgtactaacgtttaatttagtagtgggtacggtaaccccactattaactaacacgaacgaccgtccggtaggaaacggggtcccgtaattcccaactactctacaaacgaaagaactaaacttccgaaacgaaaacactattagtaataccttaanaaaattgaaaactaacctgagacgacgaagacacggaccatgtaattactggtggtacgggacttaactttacgttcgaccccggtcgggggaccccgggtaaccctggtacccacccggtcccncccccgaccctacccaaccggtaacccgg

SEQ ID NO: 418950 - DNA, 732 bp, Homo sapiens
  misc_feature: GZ8MTXP02JJXLS.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtggaggaggcttgatccagccgtgggggtcctgagctctctgtgcagtctcgtgggttcgtcaggtggcgactacagtggacgtcgtcggggtcccgccgagggcctaccggaaggggaacggggcccgtaggggaggtgggacttcctactacttttaatttagtaggtcggttacggtaaccccactaatactacacaacgacctccggtagaacgggccgtacttccaccatcctacgaagaaacgacaaacttaccgaagaaacactagttacgtaattcttaaactaaaataggtaaaactacgttaggaagtacgggaaccgaacggaaccaccgggacctaagttggttaaacgtttacgtagggttcgggtacggggtacctttaacggtttaccggttacccggtaccccggggttaccggggggtacccccgggggtaaacccgttccggtacccgtaacccccggtcccctaccccccgtaccccgttaccccgaacccggtaaaccccgggg

SEQ ID NO: 418951 - DNA, 708 bp, Homo sapiens
  misc_feature: GZ8MTXP02HXBBN.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgcttatttcaaaaggtgtccagtgtgaggtgcagttggtggagacgtgggaggaggcttgatccagccgtgggggtcctgagactctcctgtgcagtctcgtgggttcgtcgaggtggcgactacatgagcgtcgggtccgccgaggctccggaggggaacgggcctggagtggatctctactttatttataggtggtaggtaaccccactactactacacagactccggtagaacgggccattccacctatactcaagaaacgaactaacgttaccgaaggaaactaactatttacgtaacttacttaactaaaattagtaaaacttaaccgtagaacggaacggaacccggaagggaaccgaaccggacctaagttacggttatttaacgttggtagggttacgggggtaccttaacgtttacgttacccggtacccccgggtacgggggtacccccggggtaacccggttaacgggtccccgtaaaccccggtcccccgtacccccgtaacccccgtacccgtaaaccccggaaacccggg

SEQ ID NO: 418952 - DNA, 657 bp, Homo sapiens
  misc_feature: GZ8MTXP02GKT2F.21.78.H01.1.454.CMB.2.raw
  modified_base (291)..(291): a, c, t, g, unknown or other
  modified_base (304)..(304): a, c, t, g, unknown or other
  modified_base (482)..(482): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtgggtttccttgttgctatttcaaaggtgtccagtgtgaggtgcagttggtggagactgggaggaggcttgatccagccgtgggggtccctgagactctcctgtgcagtctcgtgggttcgtcaggtggcgactacagtagngcgtcgggtcccnccgaggcctccggaaggggacggcctaggaggtggatctactagtttatttataggtggtacgtaccccactatacctaacacgacgtacctccggtaggaaaccggggtccgtattcccaaccattccacaagaaacgactaacttcgaaacgtaacactattagtattacctaaanaaatagtaaactacgtagaagacgaccggaacgaccgtacggactagtacgttacgtgtggtacggtacggtactttacgttaccggacccgggtacccggggtcgggggtaccccggtaccgtccggtacccgtcccgtacccccaccccgtaccctacccgaacggtacccgg

SEQ ID NO: 418953 - DNA, 599 bp, Homo sapiens
  misc_feature: GZ8MTXP02IKQ13.21.78.H01.1.454.CMB.2.raw
  modified_base (363)..(363): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgttgggttcgtcagtggcgactacatgagcgtgggtcccgccgaggctccgagggaacggcctggagtggatctctacttattataggtggtgtaccccanatactacacacgacctccggtagaacggggccgtattccacatctacagaaagacaattaccaagaaacacgtattgtaactctactaaaatcgaaatacctgagacgaccgaggacacggctagtcgttatacgtgtggtgggctaacgtttacgtcggtacccggtcgggggacccggtaaccgtcggtacctaccccggtcctacccccgaccctaccgtaacccgaacccgg

SEQ ID NO: 418954 - DNA, 576 bp, Homo sapiens
  misc_feature: GZ8MTXP02IBSW7.21.78.H01.1.454.CMB.2.raw
  modified_base (355)..(355): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggagggcctggagtggatctctacttatttatagtggtggtacccanatactacacagactccgtgaaggccgattcacgatctcagaagacaattccgaagaacactattagtatcttacaaatagaaataacctgagagaccgagacacggcaatgtatactggtggtggggactacgtttacgtcgtaccccgtcgggggtacccgggtaacccgtcggtacccacccggtccctacccccaccccgtccgaacccgtaacccgg

SEQ ID NO: 418955 - DNA, 717 bp, Homo sapiens
  misc_feature: GZ8MTXP02JQFVC.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgtgggttctcgagtggcgactacagtgagcgtcgggtcccgccgaggcctccggaaggggaacgggccgtgggaggtggtactccgtactactttagtttagtaggttggtacggtaaccccactactactacacgacgacgtccggtagggaacgggccgtacttaccaccgtactctacaaagaaacgaactaacttacccgaaggtaaaccactagtttacgtacttaccttaaacaaaagtacgtaaaactaaccgtggaaacgtacggaaccggaaggaccgaccggtcctaagttagttacgttacgtggtacgggttacggggtactttaacggtttaccgtacccggtacccccggggtacgggggacccccgggtaaaccgtcgggtacccctaacccccggtcccctacccccgtaaccccgtacccgaacccggtaacccggg

SEQ ID NO: 418956 - DNA, 695 bp, Homo sapiens
  misc_feature: GZ8MTXP02G7T94.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtgggaggaggcttgatccagccggtgggggtccctgacgactctcctgtgcagtctcgtgggttcgtcaggtcggcgactacatgagcgtcgggtccgccgaggcctccggaggggaacggccgtggagtggactcgtctactttatttagtaggtcggtacgtaaccccactaactactaacacacgacctccggtaggaacgggccgtacttaccgaaccactcctacgaaagtaaacgaaactaaacgttacccgaaaggaaacctacttaagtttacgttaacttacttaaactaaaagttacgtaaaacttaaccgtgaacgaacggaccggaacgaccgtacggacctaagtacgttatacgtggttaggtcggggtacttacgtttacgtccggtacccgggtacgggggtacccgggtaacccgttcggtaccctacccggtccctacccccgtaccccgtaccgaaccggtaaccccggg

SEQ ID NO: 418957 - DNA, 608 bp, Homo sapiens
  misc_feature: GZ8MTXP02JT9NU.21.78.H01.1.454.CMB.2.raw
  modified_base (409)..(409): a, c, t, g, unknown or other
  modified_base (436)..(436): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgagggcctccggaaggggaacgggccgtagggagtggactctactactttatttagtagtggtcgtaccccactatacacacagactcgtagaaggccatcacatcanagagacatcagaacacatgtatactanaaatgaaatacgtgagacggaccgagacgacggacctattcgtattacgtggttcggtacggggacttacgtttaccgttcggaccccggttcgggggaccccggggtaacccgtcgggtacccgtacccgtcccgtacccccgaccccgtacccgaacccgtaaccccggg

SEQ ID NO: 418958 - DNA, 687 bp, Homo sapiens
  misc_feature: GZ8MTXP02JQJ2Y.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgcgaggcctccggagggaacgggcctaggagtggattcgtactactttatttaagtaggtggtacggtaaccccactatactacacgacgtacgtccgtaggaaacggggccgtacttccaaccattcacaaaggaaacgactaaacgttaccgaaaggaactaacgtaattagtacttacttaaaccaaaattacgaaactaaccgtagaacggaacgaccggaacggaaccgaccggactaagttacgttagttaacgtggttgggtacggggtctaacgtttaaccgttccgggaaccccggtcgggggtaaccccggggtaacccgtcgggaccgtccccgttacccgtaccccccaccccgtacccgaacccggtaacccggg

SEQ ID NO: 418959 - DNA, 708 bp, Homo sapiens
  misc_feature: GZ8MTXP02HZ7TD.21.78.H01.1.454.CMB.2.raw
  modified_base (283)..(283): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcagtggcgactacntgagcgtgggtccgccaggctccgaggggacggcctggacgtggatctcgtacttatttagtagtggtggtaccccacatactacacagactcggtagaagggccgattcaccatctacagtaacgacaattcccgaaggtaaaccacgtaatttacgtaattaccttaacaaaattcgtaaaattaacccgtagggaaacgacggaaccccggaaggacccgaaccggggtacctaacgttacggttagttaaaccgttgggttccgggttaaggggggtcctttaaactttaaccggtttacccgggacccccggggtttaggggggaaccccccgggggttaaaccgttcgggtaccccggtaaccccggttcccgtacccccccggtaacccttcccccggaaaacccgaaaccccggggg

SEQ ID NO: 418960 - DNA, 576 bp, Homo sapiens
  misc_feature: GZ8MTXP02FQHD3.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgccaggctccgagggaaggcctggagtggatctcactttatttatagtggtggtaccccacatactacacagactccgtgaagggccattccacatctcagaacgacaattcccaagaacactaattagtactacttacaaaatagaaataacctgagacgcgagacacggccatgtattacgtgtgtggggctagtttacgttcgaccccgtcgggggacccgggtaaccgtcggtccgacccgtcccgtcccccaccctcccgaaccctaacccggg

SEQ ID NO: 418961 - DNA, 586 bp, Homo sapiens
  misc_feature: GZ8MTXP02F85AX.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggcctccgaggggaagggcctggagtggatctcactttattatagtagtggtaccccacatactacacagactccgtgaacggccgattccaccatctacagaaagacaattccaagaacactattgtatcttacaaaatgaaataacctgagacgccgagacacggcatgtattacgtggtggtcggggacttacgtttacgtcggacccccggtgggggccccggggtaacccgtggtacccacccggttccctccccccgaccctcccgaccgaacccggg

SEQ ID NO: 418962 - DNA, 567 bp, Homo sapiens
  misc_feature: GZ8MTXP02JVJKR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaggcctggagtggatctcactttatttatagtggtagtaccccacatactacacagactccgtagaagggccgaattcaccatctcaagaagacaattcccaaggaacacattgtatcttacaaatgaaatacctgagagaccgagacacggaccatcgtatactgtggtcggggctacgtttacgtcgaccccgtacgggggacccgggaacctgggtccacccggtctacccccaccctccgaccgaaccggg

SEQ ID NO: 418963 - DNA, 739 bp, Homo sapiens
  misc_feature: GZ8MTXP02GBSAN.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcgaggctccgagggaacggccgtggagtggatctcactttattatgtggtggtacccacatactacacagactccgtagaacgggccgtattccgaacctagtcctacaaggaaacgactaaactttacccgaagggtaaaccactaatttagtacttacctttacaaaagttagtaaacttaaacccgtagaacggaacgggaccggaaacgggaccgaacccgggtaccctaaagttacggttaagtttaaccgttgggttacgggttacggggggtacctttaagtttttaaacccgttaccggtaaccccccggggttacgggggggacccccgggggttaaaacccccgttcggggtacccccgtaacccccggttaccccgtaccccccccgtaacccccgtttacccccgaaaccccggtaaaccccccggggg

SEQ ID NO: 418964 - DNA, 654 bp, Homo sapiens
  misc_feature: GZ8MTXP02H53V0.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccgaggctccgaggggagggcctgggagtggatcgtctacttatttataggtggtggtacccacatactacacagactcggtgaagggcctattccacatctacagaagacaacttccgaaggaacactattgtactacttacaaaatgtaaataacctaggaacgaggaccgaagggaccgacggaccaagttagtaacgtttaacgtggttacggtacgggggtacttaacgtttttaacggtccggtaacccccggggttccgggggtaccccgggggtaaaaccccgttcgggtacccgttaacccggtccctaccccccgaccccttccccgaaaccccggtaaccccggg

SEQ ID NO: 418965 - DNA, 711 bp, Homo sapiens
  misc_feature: GZ8MTXP02HBVE1.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtgggtcccgccgagggcctaccggaagggggaacgggccgtagggaggtgggaacttctactactttatttagtaggttcgggtaggtaccccacgtataactacaacacgacctccgggtaggaaacgggcccgtaattcccaactacttcaccgtaaagaaacgaactaaacgttcccgaaaaggtaaccaactagtttacgtaattccctttaaaacaaaattacgaaaacttaaccgtaggaacggtaacggaccggaagaccgacggacctagttagttaacgttcgtaggttacggtacgggtactttaacgtttaccggtccggtaccccggggttcgggggaaccccggtacccggttcggtaccccgtacccggttcccccgaccccctaccccgtaccgaaccccggtacgg

SEQ ID NO: 418966 - DNA, 609 bp, Homo sapiens
  misc_feature: GZ8MTXP02JS1SB.21.78.H01.1.454.CMB.2.raw
  modified_base (498)..(498): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtccgccaggctccgaggggaggcctggagtggatcctctacttattagtagtggtcgtacccactatacacacagctccgtaggaacggccgattcgactatcctagagaagacaacttaccaaggaacactattacgtattactactaaatgtaaactacctagagacggaccgagacgacggacagtacgtagttacgnggttggtagggggtctacgtttaccgtaccggtacccggtcgggggtaccccggaaccgtcggtacccgtacccgtcccgtaccccgacccttaccgaaccgaaccccggg

SEQ ID NO: 418967 - DNA, 688 bp, Homo sapiens
  misc_feature: GZ8MTXP02JTJJ9.21.78.H01.1.454.CMB.2.raw
  modified_base (517)..(517): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtgagactggaggagcttgatccgagccgtggggggtccctgagactctcctgtgcagtctcgttgggttcgtcaggtggcgactacatgagcgtcgggtccgccgaggccgtaccggaaggggaacggggccgtggggacggtgggactcgttactactttatttagtaggttggtcggtaaccccacactacgtacacgacgacgtcccgtaggggaactaccggattaccaaccgtatctacaaaggtaaacgaactaaacttccgaaagaacacttaagttacgtaattacttaacaaaatacgaaacttaaccgngaacgacggacggcgacgacggaccagtcgtaattacgtggtgggtacgggtcaaaacgttttcgtaccggtacccgggtaccgggggtacccccggggtaacccgtcggtaccccgtacccggtacccccgttacccccgaccccgtaccccgaacccggaaaccccggg

SEQ ID NO: 418968 - DNA, 682 bp, Homo sapiens
  misc_feature: GZ8MTXP02G1JQI.21.78.H01.1.454.CMB.2.raw
  modified_base (300)..(300): a, c, t, g, unknown or other
  modified_base (465)..(465): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctcgtgggttcgtcgagtggcgactacatgagctgggtcccnccaggctccgaggggaacggcctggagtggatctcactttattataggtggtaggtaccccacatactacacagactccggtagaaacggggcctagttccaaccgatcctacagaaacgacaaagttcccaaggtaaaccactatttacggtaatcctttaaanaaatagaaacttaaccgtaggaacggacggacccggaaaggacccgtaacgggacctaagttaggttaacgttacgtgggttacgggtacggggtactttaaacgtttacccggtaccgggtaccccggggttcggggggtaccccgggtaaccgtcgggtaccccgtaacccgttccccgtaccccccgtaacccgtaccccgaacccggtaacgg

SEQ ID NO: 418969 - DNA, 566 bp, Homo sapiens
  misc_feature: GZ8MTXP02HTT53.21.78.H01.1.454.CMB.2.raw
  modified_base (296)..(296): a, c, t, g, unknown or other
  modified_base (362)..(362): a, c, t, g, unknown or other
  modified_base (473)..(473): a, c, t, g, unknown or other
  modified_base (482)..(482): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagctgggtccnccgaggcctccgaggggaacgggcctggagtggatctctactttattagtagtggtggtaccccanatacacacagactccgtgaaggccgattcacatcacagaaagacaattccaagacacattagtatctacaaatgaaataacctgagagacgagacacggcatagtattacngtgtgggtnacgtttacgtacgacccgttcgggggacccgggtaacctggtaccacccgtccgtacccccaccctcccgaacccgaacccggg

SEQ ID NO: 418970 - DNA, 731 bp, Homo sapiens
  misc_feature: GZ8MTXP02HZM1O.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcgagttggtggagacgtggaggaggcttgatccagccgtgggggtcctgagactctcctgtgcagtctcgttgggttcgtcaggtggcgactacagtgagcgtcgggtccgccgaggcctccggaggggaacgggcctagggagtggatctactactttatttaagttaggtggtaggtacccccaagtactaactaacaactacggactccggtagggaaacggggccctaacgttaccaacctaatcctacaaaggaaacgtacctaaattcccgaaaaggtaaaccaacgttatttaacggttaacttacgttaaacaaaattacggtaaaacttaaacccgttagaaacgaacgggaccggaaagggaaccgaccgggacctagttaacgttacgttaacgtggttagggtacggggtaccttaacgttttaccggtaccggtacccccgggcgggggtaccccgggtaacccgtcggggtaccctaccccggtccctacccccgtaccccgtcccgtaaaccgaaccccgggg

SEQ ID NO: 418971 - DNA, 635 bp, Homo sapiens
  misc_feature: GZ8MTXP02GR40B.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtggggtcccgccgaggcctccgaggggaacggcctggagtggatctcactttattatagtggtcgtaccccacatactacacagtactccggtgaacggggccgattccaaccatctacagaaagacaaacttccaaaggaacactattagtatcttacaaaatgaaacttaaccgtgaagacggtaccgaacgggaccacgggaccaagttgtaagttacgtgttacggtcggggtacttacgttttaccgtcggtaacccccgtcggggggtaccccgggtaacccgtgggtaccccaacccggttccctacccccgaccctacccgaacccgtaacccggg

SEQ ID NO: 418972 - DNA, 567 bp, Homo sapiens
  misc_feature: GZ8MTXP02HEEUW.21.78.H01.1.454.CMB.2.raw
  modified_base (361)..(361): a, c, t, g, unknown or other
tcagtcgtcgctcgcacgaccggtgctcgatttagtgtgagtagtttgggtttggggggagaggagcccagcactggaattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctggggtcccgccagggctccgaggggaaggcctggagtggatctcacttattatagtggtggtaccccanatactacacagactccgtagaagggccattccacatctcagaagacaattccaaggaacacgattagtatctacaaaatgaaatacctagagagaccgaaggacacggccatcgtatacgtgtgtggggctattacgtcggaccccgtgggggacccggaaccgtcggaccaccgtcccgaccccacccgtcccaaccgaacccgg

SEQ ID NO: 418973 - DNA, 683 bp, Homo sapiens
  misc_feature: GZ8MTXP02F82QP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcaggcctccgaggggaggcctaggagtggattctacgtactttatttagtagtggtacggtaacccacatactacacaacgtactccggtaggaaacggggtcctacttccgaacctatcctacgaagaaaacgaactaaacttaccaaaggaaacctactaagttagtaacttactaacgtaaaatagtaaaactaacgtagagaacgggaccgaacggaccgaacggacccaagttagtaagttaactggttacggtaggggtacttaagttttaccgtacgtacccccgggttacgggggaccccgggggtaaccccctgggtaccccgtaccccgttaccccgtacccccacccccgttacccaacccggtaaaccccgg

SEQ ID NO: 418974 - DNA, 600 bp, Homo sapiens
  misc_feature: GZ8MTXP02JQMUO.21.78.H01.1.454.CMB.2.raw
  modified_base (387)..(387): a, c, t, g, unknown or other
  modified_base (403)..(403): a, c, t, g, unknown or other
  modified_base (412)..(412): a, c, t, g, unknown or other
  modified_base (428)..(428): a, c, t, g, unknown or other
  modified_base (482)..(482): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtcccgcccaggcctccgaggggaacgggccgtaggagtggatcgtctactttatttagtagtggtggaccccatatacacacagactccggngaacgggcctatcacntctcagaanacatcagaacactatntatctacaaatgaaactactagagacggaccgaggacacggacagtgtattcgngttaggtcggggtactagtttaccgttaccggtaccccgggtgggggaccccggtaacccgttggtacccgtaccccggttccctaccccccgtacccgaccctaccggaaacccggg

SEQ ID NO: 418975 - DNA, 710 bp, Homo sapiens
  misc_feature: GZ8MTXP02JULZP.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcagtggcgactacatggagcgtcgggtccgccgaggcctccggaaggggaacggggccgtggggaggtgggaacttccgtacgtaactttaagttttagttaaggttgggttacggttaacccccaactaacttacctaacacgaacgtaccgtccggtaggaaacggggcctattaccaacctatccgactagaaacgtaacaacttaccgaaggaacacgtatttacgtataccttaacaaacttagtaaacttaaacccgtagacggaacggaccgaagaccgaccgggacctaagttagttaacgtttacgtggttagggtcggggtacttacgtttacgttaccggtaccccggttacgggggacccccggttaaccggtccggtacccgtaccccgttcccgaccccctacccgtaccccgaccgaaaccccggg

SEQ ID NO: 418976 - DNA, 597 bp, Homo sapiens
  misc_feature: GZ8MTXP02F6C21.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccgaggcctccgaggggaacgggcctggagtggatcgtctactttatttagtaggtggtcggtacccacatactacacagactccgtagaacgggccgattccacatctacaagaaagactaaattccaagaaacacattagtatcttacaaagtgaaatacctagagaacgaccgaaggacgacggacatgtattacgtgtggtggggactagtttacgtacggtacccggtcgggggacccgggtacccgtcgggtaccacccgtcccgcccccacctcccgaccgtaacccggg

SEQ ID NO: 418977 - DNA, 684 bp, Homo sapiens
  misc_feature: GZ8MTXP02FF0OG.21.78.H01.1.454.CMB.2.raw
  modified_base (351)..(351): a, c, t, g, unknown or other
  modified_base (388)..(388): a, c, t, g, unknown or other
  modified_base (492)..(492): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctgtgggttcgtcagtggcgactacatgagctcggggtccgccaggctccgaggggaacgggcctgggagtgggatctcacgtttatttanaggtggtggtaccccacgatactacacagacttccgngaaacggggccattcaccaatctacaagaacgtaacaaacttcccgaaagggaaaccacctaatttacggtatacctttacaaaattagaaactttaaacccgngaacggacggaccggaacggaccgacggactagtagttaacttacgtaggtcgggtacgggtacttaacgtttaccgttacccggtaacccccggggtacggggggtaacccccggggtaacccgtcgggttaccccgtaccccggtacccctaccccccgtaaccccgtaccccgaacccggtaacccggg

SEQ ID NO: 418978 - DNA, 759 bp, Homo sapiens
  misc_feature: GZ8MTXP02GB6QE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgccgaggcctccggaaggggaacggggccgtgggaggtgggactcgtacctaacgttttatttaagtaggttgggttacggtaacccctaactacttaactaaccaacgaacgtacctccgggtagggaacgggtacccgtattcccaacctactcctacgaaaggaaacgaactaaaacgttcccgaaaggtaaaaccaccttaatttacgtaacttacctttaacaaaaagttcgaaaacttaacccgtaggaacgaacggaccgaaacggaccgacggacctaagtagttaaacttcgtggttagggtacggggtaccttaaacgtttttaaccgtccgggaaccccccggggtttaggggggaccccccgggttaaaacccgtcgggttaaccccgtaccccgttacccccgttcccccccaaacccgttaccccgaaacccggtaaacccccgggg

SEQ ID NO: 418979 - DNA, 751 bp, Homo sapiens
  misc_feature: GZ8MTXP02J173S.21.78.H01.1.454.CMB.2.raw
  modified_base (298)..(298): a, c, t, g, unknown or other
  modified_base (369)..(369): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccncaggctccgaggggaggcctggagtggatctctactttattataggtggtaggtacccacatactacacanacgtccgtagaaacggggccattcacctatcctacaagaaacgaactaaacttacccaaagggaaacaaccgtatttagtaactttaccttaactaaaacgttagaaaactttaaacccgtggaaagggaaccgggtacccgggaaagggtaacccgaaaccggggacccctaaagttagggttaaaacttttaacggtcgggttagggttacggggggtacctaaacggtttttaaaccgtttcccggggtaaccccccggggttacggggggggtaccccccgggggttaaaaccccgttccgggggtaacccctaaccccgggttcccccttaacccccccggaacccccttacccccggaaccccgaaaccccggggg

SEQ ID NO: 418980 - DNA, 629 bp, Homo sapiens
  misc_feature: GZ8MTXP02HW05J.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtggttcgtcagtggcgactacatgagcgtgggtcccgccgaggcctccggaggggaacgggccgtaggagtggatctactactttattagtaggtggtacggtaccccatatactacacagactccggtagtaacgggccgtattaccacatctacaaagaacaacaacttaccaaagtaacactaattgacttaccttagaaaattcgaaaataacgtgagacgacccgaaggacacggactagttagtaaatcgtgttgggtagggtactaacgtttacgttacgaccccggtacgggggtaccccgggtaaccgtcggtacctacccggtcccctaccccgacccctaccgaaccgaacccggg

SEQ ID NO: 418981 - DNA, 592 bp, Homo sapiens
  misc_feature: GZ8MTXP02GVX35.21.78.H01.1.454.CMB.2.raw
  modified_base (501)..(501): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaaggcctggagtggatctcactttatttatagtggtgtaccccactatactacacacgactccggtagaaacggggcctaattccaaccatctacaagaaagacaaacttccaaggaaaccacgaattagtaacttacttacaaaatgaaataacctgagacgaccgagaccacggccaatgtatacngtgtgggactagtttacctacgacccgtcggggcccgggtaaccctcgggtccacccggtcctcccccgacctaccccaccgtaacccggg

SEQ ID NO: 418982 - DNA, 702 bp, Homo sapiens
  misc_feature: GZ8MTXP02I0EKI.21.78.H01.1.454.CMB.2.raw
  modified_base (337)..(337): a, c, t, g, unknown or other
  modified_base (425)..(425): a, c, t, g, unknown or other
  modified_base (464)..(464): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcgaggtggcgactacagtgagcgtcgggtcccgccgaggcctccgaggggaacggccgtgggagtggntctactactttattaataggtggtcgtaaccccatatactacacagactccgtagaacggccgtactccgaaccattcacgaagaaanacaaacttccgaagtaacactagtttagtacttacttanaaaacgttagaaaacttaaccgtaggaacgtaaccgggaccggaaaggacccgaaccggaccctaaagttcgttaacgttacgtcggttagggtacggggtactttaaacgtttaccggttaccgggtacccccggggtacggggggtaacccccggtaaaccgtccgggtacccctaaccccgggttcccccacccccccgtaacccttacccccggaacccggtaaacccccgggg

SEQ ID NO: 418983 - DNA, 607 bp, Homo sapiens
  misc_feature: GZ8MTXP02F6ED6.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtcggggtcccgccgaggcctccgaggggaacggcctggagtggatctcactttattatagtggtcgtacccacatactacacagactcgtgacggcatccacatcacagaacacaattaccgaagaaacactattacgtatacttacaaaatgaaaacttaaccgtgaacgaacggaccgaaaggaccaacggcctaagtcgtaattacgtggtggtaggggacttacgtttacgtcggaccccggttagggggaccccgggtaacctcggtacccaacccgtccctacccccaccctcccgacgaaacccggg

SEQ ID NO: 418984 - DNA, 557 bp, Homo sapiens
  misc_feature: GZ8MTXP02JZH2G.21.78.H01.1.454.CMB.2.raw
  modified_base (296)..(296): a, c, t, g, unknown or other
  modified_base (337)..(337): a, c, t, g, unknown or other
  modified_base (353)..(353): a, c, t, g, unknown or other
  modified_base (399)..(399): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccnccaggctccagggaaggcctggagtggatctcacttattanagtggtggtaccccanatactacacagactccgtgaaagggccattcaccatctcagaaaanactaatccaagaacatattgtacttctaacaaatgaaataactagagagacgacgacgacgacatatatactgtgtggacgtacttacttacgtacccgtacgggaccggggaccgtaacgtaccgaccgtcctaccccaccctacccgaccgaacgg

SEQ ID NO: 418985 - DNA, 573 bp, Homo sapiens
  misc_feature: GZ8MTXP02F42I6.21.78.H01.1.454.CMB.2.raw
  modified_base (345)..(345): a, c, t, g, unknown or other
tcagtcgtcgctcgcacgaccggtgctcgatttagtgtgagtagtttggggtttgggggagaggagcccagcactgggattccgaggtgtttccattcggtgatcagcactgaacacagaggactcaccatggagttttggctgagcgtgggttttccttgttgctatttacaaaaggtgtccagtgtgaggtgcagttggtggagactggaggaggcttgatccagccgtggggggtccctgagactctcctgtgcagtctctggggttctcagtggcgactacatgagctggggtccgccaggctccgaggggaagggcctggagtggatctcacttatttanagtggtgtaccccacatactacacagactccgtgaacggggcattcacatctcagaagacaattaccagaacacattgtatacttacaaatagaaataacctagagagccgaggacacggaccatagtattactgtcgtggggactactttacttacgaccccgtcgggggacccggggaacccgtggtccaccgtccctaccccgacccctaccctaccgaacccgg

SEQ ID NO: 418986 - DNA, 594 bp, Homo sapiens
  misc_feature: GZ8MTXP02J3RG3.21.78.H01.1.454.CMB.2.raw
  modified_base (402)..(402): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggagcttgatccagcctggggggtccctgagactctcctgtgcagtctctgggttcgtcagtggcgactacatgagctgggtccgccaggctccgagggaacgggcctggagtggatctctactttatttataggtggtggtaccccactatactacacagactccgtgaacggccgattcaccatcctanaagaagacaaacttcccgaagaacactattgtaacttcttacaaaatgaaactaaccgtgagagccgaagaccacggaccagtgttatacgtggtggtggggtctacggtttactcggtaccccggtacgggggacccgggtaaaccctggtcccaccgtccctaccccgaccctaccgaccgtaacccggg

SEQ ID NO: 418987 - DNA, 583 bp, Homo sapiens
  misc_feature: GZ8MTXP02JD6BZ.21.78.H01.1.454.CMB.2.raw
  modified_base (450)..(450): a, c, t, g, unknown or other
  modified_base (557)..(557): a, c, t, g, unknown or other
tcagtcgtcgctcgcacgaccggtgctcgatttagtgtgagtagtttgggtttggggggagaggagcccagcactgggattccgaggtgtttccattcggtgatcggcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctggggttcgtcaggtggcgactacatgagctggggtcccgccaggcctccgaggggaacgggcctgggagtggatctacactttatttagtagtggtaggtaccacatactacacagactccgtgaacgggccgtattcaccatcctacaagaagacaaacttccaaggaaaccacattagtatccttanaaatgaaactaactgagacgacgagacacggacctatgtattacgtgtggtggggctagtttaccgtgaccccgtgggggacccggtaaccgtcggccgaccgtccncccccgtacctcccaccgaacggccc

SEQ ID NO: 418988 - DNA, 595 bp, Homo sapiens
  misc_feature: GZ8MTXP02IK0XV.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgagggaggcctggagtggatctctacttatttatagtggtggtaccccacatactacacacgactcgtgaacgggccgattccacatctacagaagacaattccaagaacactattagtatcttacaaatgaaataacctgagacgaccgaggaccacggccatgttattacgtggtggtggggtactacgttttaccgtcggaccccggtacgggggacccgggtaaccctgggttacccacccggttccctacccccgacccctacccgaacccgtaaacccgggg

SEQ ID NO: 418989 - DNA, 625 bp, Homo sapiens
  misc_feature: GZ8MTXP02HO2EJ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccagccgtgggggtccctgagactctcctgtgcagtctcgtgggttcgtcagtggccactacatgagcgtcggggtccgccgagggcctaccggaggggaacgggcctgggagtggatctcactttattatagtggtggtaccccacatactacacacgactccgtgaaacgggccacttcaacccatcctacaagaaacgaactaaacttacccaagggaaaccaactattagtattacttaacaaaatagaaacttaacctgaagagaccgaaggacacggacagtagtattacgtgtggtgggactacgttttacgtcgaccccggtcgggggtacccggggaaccttcgggtcccaacccggtccctacccccgacccctaccgaacccgaacccggg

SEQ ID NO: 418990 - DNA, 573 bp, Homo sapiens
  misc_feature: GZ8MTXP02HQZ6G.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccgaggctccgaggggaggcctggagtggatctcacttattatagtggtggtaccccacatactacacacgactccgtgaaacgggccgattccaccatctacagaagacaattccagaacacattagtatcttacaaatgaaataaccgtagagaggaccgaggaaccacggccaagtgtattactgtgtggggctactttacgtcgaccccgtcgggggacccgggtaccgtcggtacacccgtcctccccacccgtcccaaccgtaacccggg

SEQ ID NO: 418991 - DNA, 645 bp, Homo sapiens
  misc_feature: GZ8MTXP02GTFRG.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggcctccgaggggaacgggcctggagtgggatctcactttatttatagtggtggtaccccacgtatactacacagactccgtagaacgggccattcaccatctacagaaacgactaaattcccaaggaaacactatttagtaattcttaacaaaattgaaaataaccgtagaacgagaccgaaggaccacgggtccaatgtaacttactggtaggtacgggggtacttaacgttttacgttaccggaaccccggttcgggggtaaccccggggtaacccgtaacgggtcccgtaaccccggtcccttaccccccgaaccccgttcccgaaccccgtaaacccgggg

SEQ ID NO: 418992 - DNA, 802 bp, Homo sapiens
  misc_feature: GZ8MTXP02GFS8E.21.78.H01.1.454.CMB.2.raw
  modified_base (300)..(300): a, c, t, g, unknown or other
  modified_base (533)..(533): a, c, t, g, unknown or other
  modified_base (632)..(632): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccnccgaggcctcggaaggggacggtccgtaggagtggacttcgtactaactttatttagtaggtggtacggtaaccccctatacttaacctacaactaacgtaccgtccgggtaggaaacggggtcccgtaacttaccgaaccctattcccgaacgaaacggtaaaacgaaccctaaaacgttccccggaaaagggtaaaccctaacttaagtttacgtaactttacccttaaanaaaagttacgtaaaaactttaacccgaggaaaccgaacgggacccggaaaacggtaacctaaccgggttactaaacgggtttacttaaagttttaccgngggtttacggggtacggggtacctttaaacgtttttaccggttacccgggacccccggggtttacggggggaacccccggggttaaacccgttggggtaaccccctaaccccggttcccccttacccccccgaaaccccgttaccccggaaacccggttaaaccccgggg

SEQ ID NO: 418993 - DNA, 654 bp, Homo sapiens
  misc_feature: GZ8MTXP02JYXHY.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgaggtggcgactacatgagcgtcgggtccgccgaggcctccggaaggggaacggggccgtgggaggtggactctactactttattagtaggtggtacgtacccacatactacacacgactccgtaggaacgggccgtattaccacctatcctacgaagaaacgactaaacttaccgaagaacactattagtacttacttaacaaatagtaaactaaccgtgaagacgaccgaagaccgacggcctagtgttaatacgtggttacgggtcggggtactacgtttaccgtaccggtaccccgggtaccgggggtacccgggtaacccgtcgggtacccgacccgttcccctacccccaccccgtacccgaacccggtaaccccgg

SEQ ID NO: 418994 - DNA, 681 bp, Homo sapiens
  misc_feature: GZ8MTXP02JVODP.21.78.H01.1.454.CMB.2.raw
  modified_base (492)..(492): a, c, t, g, unknown or other
tcagtcgtcgctcgcacgaccggtgctcgattagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtggaggaggcttgatccaggccgtgggggtccctgacgactctctgtgcagtctcgtgggttcgtcagtggcgactacatggagtcgtcgggtcccgccgaggcctccggaaggggaggccgtggggagtgggactctactacgtttatttagtgtgggtacgtacccactataactacacaacgactcggtacggaacggggtccctagttaccacctatcctacgaaggaaacactaaacttaccgaagtaaacactattacgtaattcttaactaaaagtanaaacttaaccgtagaacgacggaccgaacgaacccggacggtacctaagttgtttaactacgtggttgggtacggggtctaaccgttttaccgtaccggtaccccggggtacgggggtaccccgggtaccgtccgggaccctacccgtcccgttaccccccgaccccttcccggaaccgtaaccccggg

SEQ ID NO: 418995 - DNA, 637 bp, Homo sapiens
  misc_feature: GZ8MTXP02I7T23.21.78.H01.1.454.CMB.2.raw
  modified_base (402)..(402): a, c, t, g, unknown or other
  modified_base (439)..(439): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggctccgagggacggcctggagtggatctcacttatttatagtggtcggtacccacatactacacagactccgtgaacgggccatcacatctacagaaanacaaattcccaagtaacactattgtaactccttaaanaaatacgaaactacgtagacgacgaccggaagaccgacggactaagttagttagttacgtggtacgggtacgggtacttaacgtttaccgttaccgggtacccccgggtacgggggacccccggggtaaccgtccgggtacccgtaaccccggttcccctaccccccgtaccccgtacccggaaccccggtaaccggg

SEQ ID NO: 418996 - DNA, 559 bp, Homo sapiens
  misc_feature: GZ8MTXP02FHHV3.21.78.H01.1.454.CMB.2.raw
  modified_base (343)..(343): a, c, t, g, unknown or other
  modified_base (547)..(547): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctggagtggatctcactttatttanagtggtggtaccccacatactacacagactccgtgaaaggggccaattcaccatctcagaagacaaattccaaggaaacacattagtatcttacaaaatgaaataacctagagagacgaggacacggccatgtattactgtgtggggctagtttacttcgaccccgtggggcccggggaaccctggtcaccgtctccccacccnccaccaaccggg

SEQ ID NO: 418997 - DNA, 575 bp, Homo sapiens
  misc_feature: GZ8MTXP02IASAQ.21.78.H01.1.454.CMB.2.raw
  modified_base (485)..(485): a, c, t, g, unknown or other
  modified_base (490)..(490): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcgagtggcgactacatgagcgtgggtccgccgaggcctccgaggggaaggccgtggagtggatctctacttatttagtagtggtgtaccccacatacacacagactccgtagaacggccgattcaccatctacaagaaagacaattccaagaacactattagtatcttaacaaattgaaataactgaagtacgacgagacacggcatgtatcgngtggngggtctactttacgtcgacccgtcgggggacccggtaacccgtggtcccaccggtcccaccccctaccctccgaacccgaaccgg

SEQ ID NO: 418998 - DNA, 669 bp, Homo sapiens
  misc_feature: GZ8MTXP02FM9M4.21.78.H01.1.454.CMB.2.raw
  modified_base (298)..(298): a, c, t, g, unknown or other
  modified_base (360)..(360): a, c, t, g, unknown or other
  modified_base (475)..(475): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcagtggcgactacatgagcgtgggtccnccgaggctccgaggggaaggcctggagtggatcgtcactttatttatagtggtcgtacccanatactacacagactccgtagaacgggccattccacatctacagaaagactaaacttcccaaaggaaacactaagtttagtaattacttaacaaaaattcgaaaactttaaacccnggaacgaaacggaccccggaaagggtaaccaacggggcctaaagtggttaaattaacgtggtaggggttacggggaccttaagttttaccggtaccggtacccccgggttagggggggacccccgggtaaaccctggggtacccacccggttacccctccccccgaaacccctcccgaacccggaaacccgggg

SEQ ID NO: 418999 - DNA, 678 bp, Homo sapiens
  misc_feature: GZ8MTXP02HQ97J.21.78.H01.1.454.CMB.2.raw
  modified_base (373)..(373): a, c, t, g, unknown or other
  modified_base (418)..(418): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtgggggtccctgagactctcctgtgcagtctcgttggggttcgtcaggtggcgactacatggagcgtggggtcccgccgaggcctccgaggggaacgggcctggagtgggatcgtcacttattataggtggtaggtaccccanatactacacagactccgtagaacgggccgattaccaccatcctanaacgaaagaactaacttacccgaggaaacactaatttgtaaattcttaacaaaagtataaaacgttaaactgaaggacggaccgaaagggaaccaccgggaccctaaagtacgtttaaatttaacggtgttagggtacgggggtacttaaacgttttaccgttacggtacccccggtaccgggggtacccggggaaaccccggttcggtaccgaaccccgtcccgtaccccctaccccgtacccgaacccgaaacccggg

SEQ ID NO: 419000 - DNA, 615 bp, Homo sapiens
  misc_feature: GZ8MTXP02G5S65.21.78.H01.1.454.CMB.2.raw
  modified_base (299)..(299): a, c, t, g, unknown or other
  modified_base (359)..(359): a, c, t, g, unknown or other
tcagtcgtcgctcgcacgaccggtgctcgatttagtgtgagtagtttgggtttggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccnccaagcctccgaggggaaggcctggagtggatcgtcactttattatagtggtgaccccanatactacacagactcgtagaacgggccgtattccaaccgatcctacaagaaacgaacaaacttccgaaggtaaacacctattagtaactcttacaaaatgtaaactaaccgtagacgacgaccgaagacgacggaccattagtatacgtggtggtcggggcttaacgtttcgttacggacccccggtagggggaccccgggtaaccgtcgggtcccaacccggttcccacccccacccgtcccaaccgaacccggg

SEQ ID NO: 419001 - DNA, 589 bp, Homo sapiens
  misc_feature: GZ8MTXP02F8IWD.21.78.H01.1.454.CMB.2.raw
  modified_base (480)..(480): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgccgggctcccgaggggaagggcctggagtggatctcacttatttatagtggtcggtaccactatactacacagactcgtggaacgggcattcaccatctacaagaacgacaattccaaggaacactattgtaatctacaaatagaaactacctagagagccgaagaccacggccagttntattacgtggtaggtcgggacttatttaccgtcggaccccggttcgggggacccgggtacccttcggcctacccggtccctaccccacccgtccaaccgacggtacccc

SEQ ID NO: 419002 - DNA, 715 bp, Homo sapiens
  misc_feature: GZ8MTXP02FNV9H.21.78.H01.1.454.CMB.2.raw
  modified_base (340)..(340): a, c, t, g, unknown or other
  modified_base (355)..(355): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcagtggcgactacatgagcgtgggtccgcgaggctcgaggggacggcctggagtggatctcactttattanagtggtgtaccccanatactacacacgactccgtagacgggccgtattccaaccatctacaagaaacgactaaacttaccgaagtaaaccacgtaattacgtacttaccttacgaaaagttacggtaaaacttaaacccgtaggaacgaacgggtacccggaaagggtaaccgaaccggggcctaaacgttacggttaacgtttacgttcggtacgggtttacgggggacctttaacgttttaccggttaccgggtaacccccgggttcggggggtaacccccggggtaaacccgttcgggttaccccgtaaccccggttcccccgtaaccccccgtaacccccggttacccgaaaccccggttaaaccccgggg

SEQ ID NO: 419003 - DNA, 632 bp, Homo sapiens
  misc_feature: GZ8MTXP02IJGVS.21.78.H01.1.454.CMB.2.raw
  modified_base (367)..(367): a, c, t, g, unknown or other
  modified_base (590)..(590): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtcgggtccgccgaggctccgaaggggaaggccgtgggagtggactctctactttattataggtggtggtaccccanatactacacagactccgtaggaacggccgtattccacattccactaagaacgtacaacttccgaaagtaaacactattacgtaatacttaacaaaattacgaaattaaacctgaagacgaccggaagaccacggacctagtacggttatacgtggttcggtacggggtactaacgtttacgtcgtaccccgggtgggggacccgggtaacccgtcggtaaccncccggtccctacccccgtacccctacccaacggaaccccggg

SEQ ID NO: 419004 - DNA, 675 bp, Homo sapiens
  misc_feature: GZ8MTXP02HIP5D.21.78.H01.1.454.CMB.2.raw
tcagtcgtcgctcgcacgaccggtgctcgatttagtgtgagtagtttgggtttggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctcctgtgcagtctcgtgggttcgtcaggtggcgaactacatgagcgtgggtccgccgaggcctccgaaggggaacggccgtagggagtcggatctctaactttatttagtaggtggtacgtaaccccaactatactaacacgagtacctcggtagaaagggccctattccacatcctacaaacgaaagtaacaaacttaccgaaaggaaactactaatttagtaacttacttaactaaaataagtaaactaacgttagaagtacggaccgaacggaccacggactaagtgttaattacgtggttaggtacggggtacttaacgttttaccgtacggaccccggtacgggggacccggggtaacccgtcgggtaccctacccggttacccctacccccgaacccccgtacccgaacccggtaacccggg

SEQ ID NO: 419005 - DNA, 604 bp, Homo sapiens
  misc_feature: GZ8MTXP02ILUXI.21.78.H01.1.454.CMB.2.raw
  modified_base (358)..(358): a, c, t, g, unknown or other
  modified_base (367)..(367): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcgagtggcgactacatgagcgtgggtccgccgaggctaccgaggggaaggccgtggagtggatctctacttattatgtggtgtacccanatactacanacactccgtgaacggccgatccacatctacagaaagacaattcgaagaacactattagtatactacaaatagaaattaaactgacgagaccgaggaacacggacattacgtattacgtaggtggtggggtactactttacgttaccgaccccggttcgggggaccccggggtaacccgtcgggtaccgtaacccccgtcccgtacccccgacccctacccgtaacccgaaacccggg

SEQ ID NO: 419006 - DNA, 615 bp, Homo sapiens
  misc_feature: GZ8MTXP02FO2ZE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccgccaggcctccgaggggaacgggcctggagtggatctcactttatttataggtggtggtaccccacatactacacagactccgtagaacgggccattccaaccatctacagaaacgacaaacttacccaaggaaccacgtattagtactacttacaaatgaaactacctagagacgaccgaggacacggcctaagtgtaattacgtgtggtaggggctaacgtttacgttcgtaccccggtgggggaccccggggtaaacccgtcgggtacccacccggttacctccccccgtaccctacccgaaccgtaacccggg

SEQ ID NO: 419007 - DNA, 735 bp, Homo sapiens
  misc_feature: GZ8MTXP02H25DJ.21.78.H01.1.454.CMB.2.raw
  modified_base (192)..(192): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgnagttggtggagacgtggaggaggctgatccagccgtgggggtcctgagactctcctgtgctagtctcgttgggttcgtcgaggtggcgactacatgagcgtcgggtcccgccgaggcctccggaggggaacgggccgtagggaggtgggactcttactactttaagtttaataggtgggtacgtaccccaacacttactaacacacgactccgtaggaaacggccgtattccaccgatctacaagaagaactaacttaccgaacggaaacaactagttagtacttactttaacaaattacgtaaaacttaaccgttaggaaacggacggaacccgggaaggaaacccgaccggtaaccgtaagttaaccggttaatttacgtagggttacgggtacgggggtacttaaacgttttaccggtaccgggtaacccccgggtccggggggtaacccccggggtaaaccccggttccggggttacccgtaccccggtaccccgtaccccccgtaacccccgtacccgtaaccccggaaaccccgggg

SEQ ID NO: 419008 - DNA, 589 bp, Homo sapiens
  misc_feature: GZ8MTXP02JPR94.21.78.H01.1.454.CMB.2.raw
  modified_base (297)..(297): a, c, t, g, unknown or other
  modified_base (416)..(416): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccnccgaggctccgaggggaaggcctggagtgggatcgtcaacttatttatagtggtaggtacccacatactacacagactccgtagaaacgggccgtaattccaaccatctacaagaaaanaactaataccgaagaaacatattagtactactaacaaatagaaactaactagagacgacgaagacacgacagtagtatacgtgtaggtggtactacgttacgtaccgtacccggtacggggacccggtaccgtcggtaccctaccgtcccacccctacccaccaaccgaaccg

SEQ ID NO: 419009 - DNA, 753 bp, Homo sapiens
  misc_feature: GZ8MTXP02JPZ83.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatggagcgtggggtcccgcccgagggcctccggaggggaacggccgtggagtggatctctacttatttaagtgtggtgtaaccccacatactacacagacctccggtgaacggggccctagttcaacccatctaccgaagaaacgactaaacttaccgaacggtaaaccacgtaatttcgtaacttacctttaacaaaaattcgaaaacttaaacccgttagggaaagaccgggaacccggaaacgggaacccgaaccggggaccctaagttacggtttaaactttacgttagggttggggttacgggggtacctttaaacggttttacccgttaccggggtaaaccccccggggttcgggggggtaacccccgggggtaaaccccggttcggggtaccccgtacccccgggttaccccgttaccccccaacccccgtttaccccgaaaacccggtaacccccggggg

SEQ ID NO: 419010 - DNA, 586 bp, Homo sapiens
  misc_feature: GZ8MTXP02IZR7V.21.78.H01.1.454.CMB.2.raw
  modified_base (334)..(334): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagccgtggggtcccgccaggctccgagggagggcctggagtggatctnactttatttatagtggtcgtacccacatactacacagactcgtagagggccattcacatctacagtaaacgacaacttccaaaggaaacactattagtatacttacaaatgaaaactaacctgagacgaccgaggacacggccatagtatactgtcggtaggggtctatttacgttacgaccccggtcgggggaccccgggtaccgtcggtccctaccgtccctaccccaccccgtaccaacccgaacccgg

SEQ ID NO: 419011 - DNA, 565 bp, Homo sapiens
  misc_feature: GZ8MTXP02F24XB.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccagggctccgaggggaaggcctggagtggatctcactttatttatagtggtggtaccccacatactacacagactccgtgaaacggggccattcaccatctcagaagacaattcccaaggaaacactattgtatacttacaaaatgaaataacctgaagacgaccgaggaacacggccatgtaattacgtgtgtggggctatttactcgacccgtgggggccgggtaacctggtaccaccgtcctcccccacctcccaccgaaccgg

SEQ ID NO: 419012 - DNA, 757 bp, Homo sapiens
  misc_feature: GZ8MTXP02H6N5P.21.78.H01.1.454.CMB.2.raw
  modified_base (193)..(193): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgnagttggtgagacgtggaggaggtcttgactccgaggccgtgggggtcctgagactctcctgtgctagtctcgttgggttcgtcagtggcgaactacagtgacgcgtcgggtccgccgaggcctaccggaaggggaacggccgtagggacgtggtactctactacgtttattagtaggtggtacgtacccaactacgtacaacacaacgtaccgtccgtagggaaacggtacctaaattccgaacctattacaccgaaagacgaaactaacgttaacccgaaggtaaactactaagtttacgtaacttactttaaacaaattaacggtaaaacttaaaccgttaggaacggacggaccggtaaaggaaccgaaccgggtacctaagtttaccggttaatttaaccggtaggtttagggtaacggggttactttaacgttttacccggttaccggaacccccgggggttacgggggaccccggggtaaaaccccgttcggtacccccgaaacccgttccccgtacccccgtaccccccgtaacccggaaccccggtaaacccgggg

SEQ ID NO: 419013 - DNA, 674 bp, Homo sapiens
  misc_feature: GZ8MTXP02GOOKN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagactggaggaggcttgatccagccgtgggggtcctgagactctcctgtgcagtctcgtgggttcgtcaggtggcgactacatgagcgtcgggtccgccgaggcctccgaggggaacggccgtggacgtggactctcactttattataggtggtgtaccccatatactacacacgactccgtagaacgggccgtattaccactatcctacaagaaacgaacaaacttaccgaaaggaaacactaatttacgtaacttacttaacaaaattagaaaacttaacctaggaacgacggaccgaaggaacccgacggcctaaagttcgttaatttacgtggttaaggtcggggacttacgtttaaccgtaccggacccccgggtacgggggtacccccggggtaacccgtcggtcccgaaaccccgtccccgtaccccctacccccgttacccggaaaccccgtaaccccgggg

SEQ ID NO: 419014 - DNA, 574 bp, Homo sapiens
  misc_feature: GZ8MTXP02G9C9H.21.78.H01.1.454.CMB.2.raw
  modified_base (282)..(282): a, c, t, g, unknown or other
  modified_base (286)..(286): a, c, t, g, unknown or other
  modified_base (294)..(294): a, c, t, g, unknown or other
  modified_base (396)..(396): a, c, t, g, unknown or other
  modified_base (401)..(401): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactaanatgngctggccncagctcgagggacggcgtggagtggatctactaactttattagtaggtggtacgtaaccccactataactacacacgactcgtagaacggccatcacatcanagaanacaatacaagaacactatatactactaacaaatagaaataactagagacgacgaacgacgacgacagtgtactacgtgtcggtagggtactacgtttaccgtacggacccggtcggggacccgggtaaccgtcgtaccgtacccgtcccacccctaccccaccaccgaaccgg

SEQ ID NO: 419015 - DNA, 594 bp, Homo sapiens
  misc_feature: GZ8MTXP02JWYPY.21.78.H01.1.454.CMB.2.raw
  modified_base (413)..(413): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtgggtccgccaggcctccgaggggaagggcctggagtggatctcactttattatagtggtggtaccccacatactacacagactccgtagaaacgggccgattccaccatcctacaagaaanacaaattccaaggacacattagatcttacaaatgaaataacctgagacgccgagacacggccatgtattacgtgtggtggggactacgtttacgtcggtaccccgtcgggggaccccggggtaaacccgtcgggtacccgacccgttccctaccccccacccgtcccaacccgaacccggg

SEQ ID NO: 419016 - DNA, 692 bp, Homo sapiens
  misc_feature: GZ8MTXP02HASTT.21.78.H01.1.454.CMB.2.raw
  modified_base (258)..(258): a, c, t, g, unknown or other
  modified_base (302)..(302): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaggtgtccagtgtgaggtgcagttggtggagacgtgggaggaggcttgatccgagccgtgggggtccctgagactctcctgtgcngtctcgtgggttcgtcagtggcgactacatgagcgtcgggtccnccgaggcctccggaaggggaacgggcccgtagggagtgggatcgtctaactttatttagtaggtggtacgtaccccacatactacacgagaccgtccggtaggaacgggcccgtattaccaccacttcctacaacgaaacgaactaaacgttacccaaagggaaactacctaagttacgttaacttacctttaacaaaagttacgtaaaacttaaacccgttaggaaacggacggaacccgaacgggaaccgaaccggacctaagtagttaattacgtgggttacggtacggggtacttaacgtttacgtaccggtaccccgggtacgggggacccggtaaccgtcggtcccgtacccgtcgtcccgtaccggtcccctacgaaccccgg

SEQ ID NO: 419017 - DNA, 774 bp, Homo sapiens
  misc_feature: GZ8MTXP02HRUL2.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtggggtcccgccgaggcctccggaggggaagggccgtggagtggatctctactttatttagtagtggtacggtaccccactatactacacagactccggtaggaacgggaccgtaacttaaccatctacaaagaaacgaacctaaattacccgaaaggaaacctaactagtttagtaacttacctttaacaaaagttacgtaaaacttaaacccgttaggaacggaaccggacccgggaaacgggaaccgaacccggggtaccctaaagttacggtttaactttaaccggtgggtttacgggggtacgggggtacctttaaacgttttacccggttaccgggtaaccccccggggttcgggggggaacccccgggggttaaaccccgtttcgggggtaaccccctaaccccggggtttcccccttacccccccgtaacccccgtttacccccgaaacccgggtaaacccggggttaccccccg

SEQ ID NO: 419018 - DNA, 544 bp, Homo sapiens
  misc_feature: GZ8MTXP02FO71K.21.78.H01.1.454.CMB.2.raw
  modified_base (478)..(478): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcactttattatagtggtggtacccacatactacacagactccgtgaagggccgattcacatctcagaagacaacttccagaacacgattgtatacttcaaatgaaatactagagacgaccgagacacggcatcgtatacgtgtggtggggntacgtttactcgacccgtcggggccgggaacctgggtccaccgtctcccccactcccacgaaccgg

SEQ ID NO: 419019 - DNA, 782 bp, Homo sapiens
  misc_feature: GZ8MTXP02JL10M.21.78.H01.1.454.CMB.2.raw
  modified_base (329)..(329): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgcttatttacaaaaggtgtccagtgtgaggtgctagttgggtggagacgtgggaggaggtcttgactccgaggtccggttcggggggtccctggacgtacctctccgtgtgctagtctcgtgggttcgtcgaggtcggcgactacagtcggacgcgtcgggtccnccggaggcctcggaaggggacggccgtggaggtggacttctactactttatttagtaggtggtacgtaaccccacgtaactactaacacgtacgtaccgtccgggtagggaaacgggtccgtaacttccgaacctacttcctaacgaaacggaaacgtaacctaaacttacccggaaaggtaaacctacgttaatttacgttaacttacgttaaactaaaaacgttacgtaaaaccgttaaacccggtaggaaaccgggtacggaacccgggaaacggacccgtaaacccggtacctaagttacgttaactttacggtacgggtaggggttacgggtactttaacggtttaccggtaccgggtaccccgggttccggggggaaccccggtaaccgtcggtaccccgacccgttcccccgtacccccgacccgtaccccgaccggtaaccccgg

SEQ ID NO: 419020 - DNA, 604 bp, Homo sapiens
  misc_feature: GZ8MTXP02JI5ZS.21.78.H01.1.454.CMB.2.raw
  modified_base (299)..(299): a, c, t, g, unknown or other
  modified_base (410)..(410): a, c, t, g, unknown or other
  modified_base (493)..(493): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccnccaggctccgagggaggcctggagtggatcgtcactttatttagtagtggtcggtaccccacatactacacagactccggtagaacgggccgtattcactatctacagaanacaatcaagtaacacattgtatacttacaaaatgaaactaaccgtgaagacggaccgaaggacacgggcctagtagtattacnggtcggtggggtactacgtttaccgttcgtacccccggtagggggaccccgggtaacccgtggtacccgtacccggtccaccccccgtaccctacccacccggaacccggg

SEQ ID NO: 419021 - DNA, 777 bp, Homo sapiens
  misc_feature: GZ8MTXP02G2NN5.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagctctcctgtgcagtctcgtgggttcgtcaggtcggcgtactacatgagcgtcgggtccgccgaggcctaccggaaggggaacggcccgtgggacggtgggtaattccgttacgtaacttttagtttaaagttaggttacggggttacggtaaccccctaactaacttaaacctacgaaccaacgtaccgtcccggtagggaacgggggtacccgtacttaccaacctacgtccttaaccgaagtaaaacgtaaccaaacgtttacccgaaagggaaacctaacctaagtttacgtaacttaccttaaactaaaagtaacgtaaaactaaacccgttagaaccgggaacggaccggaaacggtaccgaacccgggtactacgttaagttaactttaccgtgggttagggtggggactttacgtttaacccgtcggtacccccggggtcgggggaccccgggggttaaacccgtcgggtaccgtacccccggttaccctccccccgaacccttaccccgaacccggaaaccccggg

SEQ ID NO: 419022 - DNA, 644 bp, Homo sapiens
  misc_feature: GZ8MTXP02JG1CE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgtcagtggcgactacatgagcgtgggtccgccgaggctccgagggaaggccgtggagtggatctctactttatttagtagtggtgtacccacactactacacacgactccgtgaacggccgatcgacactctacagaaacgacgaacttccgaaggaaacactagtttagtatcttataaaatagtaaactaacctgaagtacggaccgaaggacaccggacctattagttagtacgtggtacgggtcggggacttaaacgttttaccgtaccgggtacccccggtcggggggaccccgggtaaaccccgttggtaccccgtaaccccggttcccctacccccctacccgttacccccgaacggtaaacccccgggg

SEQ ID NO: 419023 - DNA, 626 bp, Homo sapiens
  misc_feature: GZ8MTXP02HSHMM.21.78.H01.1.454.CMB.2.raw
  modified_base (391)..(391): a, c, t, g, unknown or other
  modified_base (418)..(418): a, c, t, g, unknown or other
  modified_base (444)..(444): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttcgtcagtggcgactacatgagcgtcgggtccgccaggctccgagggatcggcgtggagtggatctctacttatttatgtggtcgtaccacatactacacagctcgtagacggccatcacatctanagaagaacaatccaaggaacactattntatacttacaaatagaaacttaaccngaacgacgaccggaggaccacgggacctagttcgttaaatttacgtgggttacggttgggggtacttaacgttttaccgtaccgggtacccccggttcggggggaccccggggtaaacccgttcggggtaccctaccccggtacccctacccccccgtaccccgttaccccgaaacccccgg

SEQ ID NO: 419024 - DNA, 847 bp, Homo sapiens
  misc_feature: GZ8MTXP02I2M14.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgttgggttcgtcagtggcgactacatgagtcgtcggggtccgccgaggcctccggaaggggacgggccgtggaggtggacttctctactttattagttagtggtcggtaccccactatactacacacgactccgtagaacggggccgattaccgacctagtcctacgaagaaacgtaacaaacgtttacccgaaagggtaaacctaactaacgttttaggttaacttaccctttaacgaaaaatttacgggtaaaaacttaaccccgtttaggggaaaccggtaacgggaacccccggggaaaaggggaaaccccgtaaccggggaccccttaaaagttacgggtttaaacgtttaaccgggtttaaggggtttcgggggttacggggggttaaacctttaaacggtttttaaaccccggggtttacccggggttaaaacccccccgggggttccgggggggggttaaccccccgggggttaaaaccccgttcccgggggttaaaccccggaccccccggtttacccccgtaccccccccggtaaccccccgtacccccgtaaaccccgggtaaaacccccggggg

SEQ ID NO: 419025 - DNA, 636 bp, Homo sapiens
  misc_feature: GZ8MTXP02IXQ8P.21.78.H01.1.454.CMB.2.raw
  modified_base (300)..(300): a, c, t, g, unknown or other
  modified_base (330)..(330): a, c, t, g, unknown or other
  modified_base (365)..(365): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctctgggttcgtcagtggcgactacatgagcgtggggcccnccgaggcctccgaaggggaacggcctaggngtggatctcactttattatagtggtcgtaccccanatactacacacgactcggtagaacgggccgattccaacatctacagtaaagactaaattcccaaaggaaaccactattagttactacttacaaaatagaaacttaacctaggaacgaggacccgaagggacaccgggacaagtggttaatacgttaggtaggtgggggtacttaacgtttacgttaccggaccccggtacgggggccccgggtaaaccgtcggggtacctacccggtcccttccccgacccgtaccacccgtaaacccggg

SEQ ID NO: 419026 - DNA, 665 bp, Homo sapiens
  misc_feature: GZ8MTXP02GPKQI.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtcccgccgaggcctccgaggggacgggccgtggaggtggatctactactttatttagtaggtggtcggtaccccactatactacacgacgactccggtagaacgggccgtattccacatctacagaaagaactaacttccaaggaacactattagtacttacttacaaatacgaaactacctagaacgagaccggaaggaacaccgggacctaagttgtaactttacgtggttagggtcggggtacttaacgtttacgtaccggtacccccgggtacgggggtaaccccgggggttaccccgttcgggtacccgtaccccggttccccgtaccccccgtaccccgttacccgaaacccggtaaccccgggg

SEQ ID NO: 419027 - DNA, 611 bp, Homo sapiens
  misc_feature: GZ8MTXP02IQDBF.21.78.H01.1.454.CMB.2.raw
  modified_base (372)..(372): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtgggagactgggaggaggcttgatccagccgtgggggtccctgagactctcctgtgcagtctcgtgggttcgtcagtggcgactacatgagccgtggggtcccgccgagggcctccggaaggggacgggccgtggagtggactctctacttatttatagtggtggtaccccanatactacacagactccggtagaacggccgattccacatcacagaagacaattccaagaacactattagtactacttacaaaatagaaactaacctgacgacggaccgaaggaccgacggctaagtgtaattactggtcggtagggtctacgtttaccgtcgaccccgggttgggggaccccggtaacccgtgggtaccctacccggtccctacccccacccctccgaacccgaacccgg

SEQ ID NO: 419028 - DNA, 567 bp, Homo sapiens
  misc_feature: GZ8MTXP02F1ZWH.21.78.H01.1.454.CMB.2.raw
tcagtcgtcgctcgcacgaccggtgctcgatttagtgtgagtagtttggggtttgggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccctggggggtccctgagactctcctgtgcagtctctgggttcgtcagtggcgactacatgagctggggtcccgccaggctccaggggaaggggcctggagtggatctcacttatttatagtggtggtaccccacatactacacagactccgtgaacgggccgattcaccatctacagaagacaattccaaggaacacattgtatctacaaatgaaatacctgagagcgaggacacggccatgtatactgtcgtggggctatttacgtcgaccccgtgggggacccggggaaccctgggtccaaccggtcctacccccaccctaccgacctaacccggg

SEQ ID NO: 419029 - DNA, 775 bp, Homo sapiens
  misc_feature: GZ8MTXP02GWOJM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtgggaggaggtcttgactccgagtccggtcgggggtccctggagactctcctgtgcagtctcgttgggttcgtcgagtcggcgactacagtgagcgtcgggtcccgccgaggcctaccggaggggaacgggccgtaggaggtggtacgtccttacgtaactttagtttaagtaggtcgggttacggtacccctaactaacttaacctaacaacctaacggtacccgttccgggtaacgggaaacggggtcccgtactttacccgaaccctacgtccctaaaccaagggtaaaactaaacctaaacgttcccgaaaaggtaaaccacgttaagtttacgtaaacttacctttaaccaaaaattcggtaaaaacttacccgtaggaacggacgaaccggaagaaaccgacggtactaagttacgttaattacgtaggttacgggtacggtactttaacgtttacccgggttccggaccccgggtccgggggtaacccgggtaacccgtcggtaccccctacccggttccccaccccccgacccgttaccgaacccggtaaccccggg

SEQ ID NO: 419030 - DNA, 773 bp, Homo sapiens
  misc_feature: GZ8MTXP02GIJS4.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgagactctcctgtgcagtctcgtgggttcgtcaggtggcgactacatgagcgtgggtccgccgaggcctccgaggggaacgggcctgggacgtgggatctctaactttatttaagtaggtgggtacggtaaccccaactaattaactaacacaacggacctccggtaggaaacgggggtcccgtaatttcccgaacctatccctacgaagaaacgaactaaacttacccaaaggaaaccactatttacgtaactaccttaacaaaatagtaaaacttaacccgtagtaacgacgggacccgaaacgggaaccgaaccgggaccctaaagttacggttaaactttacgttacgggttagggttacgggggtacctttaaacggtttttaaacccggttccgggtaaccccccggggttacggggggtaacccccgggggtaaccccgttaacgggggtaccccgtaaccccggttcccccgtacccccccgtaacccccgttaacccccgaacccggtaaaacccccggggg

SEQ ID NO: 419031 - DNA, 613 bp, Homo sapiens
  misc_feature: GZ8MTXP02FR0T9.21.78.H01.1.454.CMB.2.raw
  modified_base (347)..(347): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcaggtggcgactacatgagcgtgggtccgccgaggctccgaggggaaggcctgggagtggatctcactttatttanaggtggtcggtaccccacatactacacagactccgtggaacgggccgattccacatctacagaacgacaaacttccgaagaacactattagtatacctacaaaatgaaataacctgagagaccgagacacggactatgtattacgtggtggtggggtctacgtttacgtaccggtacccccgggtcgggggaccccggggtaaccgttcgggtacccgtacccgttcccctacccccgtacccctacccgaaccgaaaccccgggg

SEQ ID NO: 419032 - DNA, 649 bp, Homo sapiens
  misc_feature: GZ8MTXP02G64TD.21.78.H01.1.454.CMB.2.raw
  modified_base (368)..(368): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcagtgcgactacatgagcgtcgggtccgccgaggcctaccgaggggaacgggccgtgggagtggatcgtctactttatttagtaggtggtggtaccccanatactacacagactccggtagaacggaccgtattaaccatctacaacgaaagactaattaccgaaggaaacactattgtacttcttacaaaatagaaacttacctaggaagacgacccggaggaaccacggtacctaagtacgtattacgtggtcggttacggggactttagtttaccgttacggaacccccgggttcggggggaaccccgggttaaccctcggggtaacctacccccgtccctacccccgaccctacccgaaccccgacggggtaccccc

SEQ ID NO: 419033 - DNA, 601 bp, Homo sapiens
  misc_feature: GZ8MTXP02HHZCF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtcgggtccgccgaggcctccggaggggaacggggccgtggagtggatctctattattatagtggtgtacccacatactacacagactcgtagaacggccgtattccacatctacaagaaacgaactaactccgaaagaaacactattagtattacttaacaaatagaaataacctgagagacgagacacgccatagtatactggtgtaggggtactacttacgttacggtacccggtacgggggacccggggtaacccgtcggtaccgtacccgtccctacccccgacccctacccgaaccgaacccggg

SEQ ID NO: 419034 - DNA, 724 bp, Homo sapiens
  misc_feature: GZ8MTXP02HTL3M.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtgggaggaggcttgatccagccgtcgggggtcctgagactctcctgtgcagtctcgtgggttcgtcaggtggcgactacagtgagcgtcgggtccgcgaggcctaccggagggaacgggcctaggggagtgggatctactactttatttaagtaggttggtacggtaccccactatactacacagactccggtaggaacgggcctacttccacctatcctacaagaaacgaactaaacttacccgaaaggaaactaacttaatttacgtaacttaccttaactaaaattaggtaaaacttaaaccgttaggaacggtaacggacccggaaacgggaaccgaaccgggtacctagttagttaacgtttaacgttggttacgggtcgggggttacttacgttttaccggttaccggtaccccggggtaccgggggtaccccggggtaaccgttccgggtacccgtaccccggttcccctacccccgtaccccctacccggaacccggtaaccccggg

SEQ ID NO: 419035 - DNA, 601 bp, Homo sapiens
  misc_feature: GZ8MTXP02IN3GI.21.78.H01.1.454.CMB.2.raw
  modified_base (359)..(359): a, c, t, g, unknown or other
  modified_base (395)..(395): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgcagtggcgactacatgagctgggtccgccgaggctccgaggggaggcctggagtggatctctacttatttatagtggtaggtaccccanatactacacacgactcgtgaacgggccgattccacntctcagaagacaattaccgaagaacacattagtatcttacaaattacgaaataacctgaacgaggaccgaggaacacggccatacgttatacgtggttggtcggggtctacgttttaaccgtcgtaccccggtcgggggacccggggtaacccgtcggtccgtacccggtccctacccccgaaccccgtccacccgtaaacccggg

SEQ ID NO: 419036 - DNA, 679 bp, Homo sapiens
  misc_feature: GZ8MTXP02JCF1L.21.78.H01.1.454.CMB.2.raw
  modified_base (304)..(304): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccgagccgtgggggtcctgagactctcctgtgcagtctcgttgggttctcaggtggcgactacatgagcgtcgggtccnccgaggcctccggaggggaacggccgtaggagtggactctactactttattagtagtggtacgtaccccacatactacacagactccggtagaacggccgtattccactatctacaagaacgaactaacttaccgaaaggaacactaatttacgtaactacttaacaaaattagtaaaacttaaccgtagaacggacggaccgaacggaccaccggacctaagttagttaacttacggtaggttcgggtacggggtacttaacggtttaccgttaccgggtacccccgggtacgggggaacccgggtaacccgtcgggtaccctaccccggttacccctacccccgtaccccgtacccgaacccgtaaccccggg

SEQ ID NO: 419037 - DNA, 681 bp, Homo sapiens
  misc_feature: GZ8MTXP02F5P5M.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagcgtgggtccgccaggcctccgaggggaacgggcctggaggtggattcctctactttatttagtaggttggtacggttaccccactataactaacaacacgaactccgggtaggaaacggggccgtaacttccaaccctatacctacgaaacgaaacgactaaaacttcccgaaaggaaaccaacgtaatttcgtaattacttaacgaaaattagaaaacttaaccgagacgtacgaccggaacgacacgggcctaagttcgtaacgtttacgtggtacgggtggggtactacgtttaccgttacggacccccggttcgggggacccgggttaaaccccgtggtaccctacccggttcccctacccctaccccgacccgaccgaacccgggg

SEQ ID NO: 419038 - DNA, 661 bp, Homo sapiens
  misc_feature: GZ8MTXP02H8SGP.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctctgtgcagtctcgtgggttcgtcagtgcgactacatgagcgtcgggtccgccgaggcctccggaggggaaggggtcccgtagggaggtggacttcgtacttacgtttatttagttaggtgggtaggtaccccaacgtaatacctaacacgtacgaacgtccgtagggaaacgggcccgtattacccgaccctatacctaccaaaggaaacaaactaaacgtttacccgaagggtaaaacctaccgtaatttacgtacttaccttaacaaaattgaaaacttaaccgttgaacgacgaccggagaccgacggacagtgtaatacgtgtacggtgggtacttacttacgtacgaccccggtcgggggtaccggaccgtcggtccgaccgtcctaccccacccgtaccaccgacccgg

SEQ ID NO: 419039 - DNA, 643 bp, Homo sapiens
  misc_feature: GZ8MTXP02H2IUZ.21.78.H01.1.454.CMB.2.raw
  modified_base (381)..(381): a, c, t, g, unknown or other
  modified_base (444)..(444): a, c, t, g, unknown or other
  modified_base (457)..(457): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggttggtggagacgtggaggaggcttgatccaggccgtgggggtcctgagactctcctgtgctagtctcgttgggttctcgagtggcgactacatgagcgtgggtccgccgagcctcgaggggaacggccgtaggagtggactcgtctaacttatttagtagtggtggtaccccatatactacanagactccgtagaaggccgtattcaccatctacagaaagactaactccaagtaacaactagttnaacttccttaaanaaatgtaaactacgtagacgacgaccgaacgaccgacgactagttacgttacttacgtggttcggtacggtacttaacgtttaccgtaccggtaaccccggggtacgggggtaaccccggtacccgtccggtaccctaccccggtcccctaccccccgtaccccgtacccgaaacccggtacccgg

SEQ ID NO: 419040 - DNA, 644 bp, Homo sapiens
  misc_feature: GZ8MTXP02GT5CI.21.78.H01.1.454.CMB.2.raw
  modified_base (404)..(404): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatcagccgtgggggtccctgagactctcctgtgcagtctcgtgggttcgtcagtggcgactacatgagcgtgggtccgccgaggctcggagggaggccgtggacgtgatctactactttattagtgtggtacggtaccccatactactaacacacgactcggtagacgggccgtattcaactntctacaagaaacgactaactaccgaagaaacaacctattacgtactacttaacaaaatcaaacttaacccgtagacgacggaccgaacggacgacggacctaagttacgtattagtcggtggtcggggtactacgtttaccggtccgaccccggggttcgggggacccgggggtaacccgtcgggtccccgtacccgtacccctacccccgtaccccgtaccccgtacccggaaccccgg

SEQ ID NO: 419041 - DNA, 638 bp, Homo sapiens
  misc_feature: GZ8MTXP02HOEYT.21.78.H01.1.454.CMB.2.raw
  modified_base (410)..(410): a, c, t, g, unknown or other
  modified_base (416)..(416): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccgaggcctccgaggggaacggggcctgggagtggatctctacttatttatagtggtggtaccccactatactacacaagactccgtagaacgggccgattcaccatcctnaagaanacaactccaagaacatactagtatacttacaaatagaaataaccgtagaacgtagaccgaggaacacggaccagttagttaacttaacgtggttaggtacgggggtactacgtttacgttaccggtaccccggtcgggggtacccggggtaacccgtaacggggtccctaaccgggttcccctacccccgtaccccgtccccgtaaaccgtaaaccccgggg

SEQ ID NO: 419042 - DNA, 657 bp, Homo sapiens
  misc_feature: GZ8MTXP02FITGB.21.78.H01.1.454.CMB.2.raw
  modified_base (347)..(347): a, c, t, g, unknown or other
  modified_base (363)..(363): a, c, t, g, unknown or other
  modified_base (510)..(510): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtggggtccgccagggctccgaggggaagggcctggagtggatctcactttatttanagtggtggtaccccanatactacacagactccgagaaggccattcacatctacagaaacgacaacttcccaaaggaaccactatttacgtatcttacaaaatgaaacttaaccctgaaggacgaccgaagggaccaacgggcctagtacggttaatttaccgnggttagggtacgggggcttaacgtttaccgtttacggaaccccccgggtttcggggggaacccccggggttaaaaccccgtggggttaccccgaaccccggttccccttaccccccgaacccgtacccccaaccggaaaccccgggg

SEQ ID NO: 419043 - DNA, 619 bp, Homo sapiens
  misc_feature: GZ8MTXP02HF0SB.21.78.H01.1.454.CMB.2.raw
  modified_base (360)..(360): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccaggctccgaggggaaggcctggagtggatctctacttatttatagtggtgtaccccanatactacacagactccgtagaaaggccgattcaccatctacagaacgacaatccaagaacactattgtatctaactaaatagaaactaacctagaagacgggacgaacggaaccgacggacctatagttaacttagtacggttgggtacggggtactacgttttaacgttaccggtacccgggtaccggggacccggggtaacccgtcggtaccgtaccccgtccgtacccccctacccgtaccccgaccgtaacccgg

SEQ ID NO: 419044 - DNA, 619 bp, Homo sapiens
  misc_feature: GZ8MTXP02JD44N.21.78.H01.1.454.CMB.2.raw
  modified_base (509)..(509): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgacctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccgccaggctccgaggggaacggccgtggagtggatctctactttatttagtgtggtcggtaccactatactacacagacctcgtgaacggccgtattccgacctatcctacaaagaaacgtaacaacttcccgaaaggaaaccactattgtaactcttaacaaatgaaacttaacctgaacgagaccgaaggacaccggcatcgtattacgngtggtcgggattagtttaccgttacggaccccgtcgggggaccccgggtaaccttcgggccctaacccggtcccctacccccgaccctcccgaacccggaccggtacccc

SEQ ID NO: 419045 - DNA, 716 bp, Homo sapiens
  misc_feature: GZ8MTXP02GHRBG.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtccgccgaggcctccgaaggggaacggccgtggagtggatctctactttatttagtagtggtgtaccccacatactacacgacgactccggtagaaacgggcccgtattacccaccgattacctacgaaagaaacgaacctaaacttacccgaaacgggaaaacccactaaagtttacgtaacttaccgttaacaaaaagttacgaaaacgttaaacccgttaggaaacggaacggacccggaaaacggacccgaaccgggtaccctaacggttagttaacgtttacgtgggttagggtggggtaccttaacgttttaccggtaccggtacccccggggtacgggggacccccggggtaacccgtcggtacccgtaccccgtcccgtacccccctacccgtaccccgaacccgaacccggg

SEQ ID NO: 419046 - DNA, 811 bp, Homo sapiens
  misc_feature: GZ8MTXP02FQWWU.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcgggtcccgccgaggcctaccggagggggaaggcctgggaggtggacttccgtactactttagtttaagtaggtggtacggtaccccactactaacgtacaacacgtaaccttccggggagaaacggggccgtaactttacccgaacctactaccttacgaaacggtaaaacgaactaaactttacccgaaagggaaacctaacgttaagtttacggtttaacttacctttaaaccaaaagtttacggtaaaaacttaaccccgttagggaaacgggaccggaccggaaacgggaaccaacccgggaaccgttaagttccgtttaaagttaccgttgggttacgggttacgggggtacctttaacgtttttacccgggtaccggggttaaccccccgggttacggggggacccccgggggtaacccgttaaccgggggttaccccctaacccccgggttacccccttacccccccgtaaccccggttacccccgaacccggttaaaaccccccggggg

SEQ ID NO: 419047 - DNA, 571 bp, Homo sapiens
  misc_feature: GZ8MTXP02I6DPC.21.78.H01.1.454.CMB.2.raw
  modified_base (364)..(364): a, c, t, g, unknown or other
  modified_base (400)..(400): a, c, t, g, unknown or other
  modified_base (433)..(433): a, c, t, g, unknown or other
  modified_base (438)..(438): a, c, t, g, unknown or other
  modified_base (479)..(479): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccgaggcctccggaggggaacgggccgtggagtggatctctactttattatagtggtgacccanatactacacagactcgtgaacggccgattcacatcnagaagacaatcgaagaacacattagtatctaanaaatnaaactaactgagacgacgagacacgcagtgtatcaggtcgngggcttacgttacgttcgaccccggtacgggggcccggtaaaccgtcggtaccacccgttcccacccccgacctaccccgaacgtaacccgg

SEQ ID NO: 419048 - DNA, 604 bp, Homo sapiens
  misc_feature: GZ8MTXP02JB9B4.21.78.H01.1.454.CMB.2.raw
  modified_base (372)..(372): a, c, t, g, unknown or other
  modified_base (496)..(496): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccgagggcctaccggaggggaacgggccgtggagtgggactctctacttatttagtagtggtgtaccccanatacacacagactcgtagaacggccatccacatcacagaagacaatcaagaacactattagtatacttacaaatagtaaactaacgtagacgaacgaccgaaggacgacgccatgtaattacgnggtaggtcgggtatactttaacgtccggacccggtacggggggacccggtaacccgtcggaccctacccggttccccacccccaccctaccccgaaccgtaacccggg

SEQ ID NO: 419049 - DNA, 609 bp, Homo sapiens
  misc_feature: GZ8MTXP02JDQA8.21.78.H01.1.454.CMB.2.raw
  modified_base (413)..(413): a, c, t, g, unknown or other
  modified_base (454)..(454): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttctcaggtggcgactacatgagcgtcgggtccgccaggcctccgaggggaacgggcctggagtggatctctactttatttagtaggtggttacggtaccccacactactacacacgactccggtgaacgggccattccgacatctnagaaagacaattccgaagaacactattgtatcttacaaatnaaatactgagacgacgagacacggcatgtatacgtgtggtcggggtactacgtttacgtcggtaccccggtacgggggacccgggggtaacccgttcgggtacccgtacccgtcccgtacccccgtaccccgtacccgaacccggtaaccccggg

SEQ ID NO: 419050 - DNA, 653 bp, Homo sapiens
  misc_feature: GZ8MTXP02GUU0K.21.78.H01.1.454.CMB.2.raw
  modified_base (368)..(368): a, c, t, g, unknown or other
  modified_base (509)..(509): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtcgggtccgccgaggcctccgaggggaacggccgtggagtggatctctacttagtttatagtggtaggtaccccanatactacacagactccgtagaacggccgtattccaaccgtatctacaagaaacgacaacgttaccgaaggtaaaccacgtattagtactacttactaaaatgaaaactaccgtagagacggacgacggacacggccagttntacttacgtggtggtacggggtacttacgtttacgtacggtaccccgggtaccgggggtacccggggtaacccgtcggggtacccgtaaccccggttcccgtaccccccgtaccccgttacccgtaaccccggtaaacccgggg

SEQ ID NO: 419051 - DNA, 714 bp, Homo sapiens
  misc_feature: GZ8MTXP02GZMUO.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcgagtggcgactacagtgagcgtcgggtccgccgaggcctccggaggggaacgggccgtaggagtggacttctctactttatttagtaggtggttacggtaaccccacgtaatactaactacacgtaaccgttccgggtagaaacggggtcccgtaatttccgaaacctattcctaaccgaagaaaacgacctaaaacttcccgaaaggaaacctaccgtaagtttacgtaacttaccgttaactaaaaattcggaaaacttaaacccgtaggaacgaacgggacccgaaaggaaccacgggtacctaagttaacgttattaacgtggtagggttcgggacttacgtttacgtccggaccccggtacgggggacccgggtaaaccctcggtaccctaacccgttccccacccccaccccgttacccaacccggtaaccccgg

SEQ ID NO: 419052 - DNA, 700 bp, Homo sapiens
  misc_feature: GZ8MTXP02J0757.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagagtactcaccatggagttttggctgagctgggttttccttgttgctatttcaaaggtgtccagtgtgaggtgcagttggtggagactggaggaggcttgatccagccgtgggggtccctgagactctcctgtgctagtctcgtgggttcgtcaggtggacgactacatgagcgtcgggtccgccgaggctccgaggggacggctggagtggatctctacttattagtaggtggtagtaaccccatataactacacacgaccgtccggtaggaacggggtccattccacctatctacaaagaaacgacctaaacttaccgaaagtaacactagtttacgtaattaccgtttaacaaaagttacgtaaaactaaccgtaggaaggaccgggtacccggaaggacccgaacgggcctaaggttacgttacttacgtggttaggggtacggggtaccttaacgttttacccggtacggtacccccggggttacggggggaacccccgggttaacccgtcgggttaccccgtaacccccgttccccgtaaccccccgtaccccacccggaacccggtaaccccgggg

SEQ ID NO: 419053 - DNA, 583 bp, Homo sapiens
  misc_feature: GZ8MTXP02JC6PL.21.78.H01.1.454.CMB.2.raw
  modified_base (369)..(369): a, c, t, g, unknown or other
  modified_base (447)..(447): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatggagccgtgggtcccgccgaggcctccggaaggggacggccgtggagtggatctctactttattataggtggtagtaccccanatactacacagactccgtagacggggccattccacatctacagaaagacaattcccgaagaacatattgtatacttanaaactgaaactactgacgacgacgagacgacgacctatgtagtactggtggtgggtactattacgttccgaccggtcgggggacccggtaccgtgtccgtaccgtccccaccccacccgtaccctaccgaacccgg

SEQ ID NO: 419054 - DNA, 693 bp, Homo sapiens
  misc_feature: GZ8MTXP02JNYVO.21.78.H01.1.454.CMB.2.raw
  modified_base (362)..(362): a, c, t, g, unknown or other
tcagtcgtcgctcgcacgaccggtgctcgatttagtgtgagtagtttggggtttgggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggcttgatccagccgtcgggggtcctgagactctcctgtgcagtctcgtgggttcgtcaggtggcgactacatgagcgtcgggtccgccgaggctccgaggggacggcctggagtggatctcactttattagtagtggtgtaccccanatactacacacgactcgtaggaacgggccattaccaccatctacgaagaaacgaactaacgttaccgaaacggaaacaactatttacgtaattcccttaaataaatacgaaaacttaaacccgttagaacggaaacggacccggaaagggacccgaaccgggtaccctaaagttacgttaacgtttaacgtggttacgggtgggggtaccttaacgttttaccggttaccggtaccccgggttacggggggaccccgggttaaacccggtcgggtacccgtacccggttaccccctacccccgacccccgtacccgaacccggaacccggg

SEQ ID NO: 419055 - DNA, 628 bp, Homo sapiens
  misc_feature: GZ8MTXP02GASZD.21.78.H01.1.454.CMB.2.raw
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtggttcgtcaggtggcgactacatgagcgtcgggtccgccgaggcctccgaggggaacgggccgtggagtggactctctactttatttagtagtggtcggtaaccccactataactacacacgtactccggtagaacggggccgtattccacatctacagaaacgacaactacaagaacactattacgtatacttaactaaatagtaaattaatcgtagaaggacgaccggaaggacgacggactagtagtattacgtgtaggtggggtacttacgtttacgttccggacccggtcgggggtacccggggaacccgttcgggtacccgtacccggtcccgtacccccaccccgtacccgaacccgg

SEQ ID NO: 419056 - DNA, 680 bp, Homo sapiens
  misc_feature: GZ8MTXP02JFVJR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcaggtggcgactacatgagcgtcgggtccgccagggcctccgaggggaacgggcctgggagtggatcgtctacttatttagtagtggtacgtaacccacatactacacagactccgtagaacgggcctatcgaccatctacagtaacgacaattaccgaaggaaacacgtaattagtatacttactaaaatagtaaaactaaccgtaggaagacggaccgaagggaccgaaccggacctaagttacgttaacgttacgtagggttacggtacgggggtaccttaacgttttaccgttacggtaccccccgggttcgggggtaacccccgggggtaacccgtccgggttacccggtaccccggttacccctaccccccgtacccgttaccccgaacccgtaaaccccggg

SEQ ID NO: 419057 - DNA, 837 bp, Homo sapiens
  misc_feature: GZ8MTXP02JUMOE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgaggtggcgactacagtgacgcgtcgggtcccgccgaggcctaccggaggggaacgggtccgtagggaggtgggacttcgtaccttaacgtttagtttaagttacggttggggtacggtaaccccctaactaaacgttaaccttaaccaacgaacggtaacccgttcccggggtaacgggaaaccgggggtaccccgtaactttacccaaaccctacgttacccgtaaccgaaacgtaaacggaaaccttaaaccgttacccgaaagggtaaaccctaacttaagtttacgttaacttaccttaaactaaaagttagtaaaacgttaaccggtagaaacgggaacggaacccggaaagggaaacccgaccgggtaaccgtaagtttacggttaactttaaccggtggttacggggttcggggtaccgtttaaacgttttaccggttacccggtacccccggggttaccggggggtacccccgggttaacccggttcgggtaccccgtacccggttacccccctacccccgtaacccccgtaccccgaaaccccggtaacccggg

SEQ ID NO: 419058 - DNA, 779 bp, Homo sapiens
  misc_feature: GZ8MTXP02I3N13.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttctttgttgctatttcaaaggtgtcagtgtgaggtgcagttggtggagacgtgggaggaggcttgatccagccgtgggggtccctgagactctcctgtgcagtctcgtgggttcgtcgagtggcgactacatggagcgtcgggtcccgcccgaggcctccggaaggggtaacggggcccgtagggacggtggacttccgtactacttttaagtttaagtaggtgggtcggtaaccccataactacctaacacgaacgaccgtccggtaggaaacggggtaccgtacttccaacctactacctaccaagtaaacgaaactaacgttacccgaaagaaactaccgtaattacgtaacttcttaacaaaattacggaaaacttaaaccgtgaacggtaacggacccggaacggaaccgaaccgggacctaaagtttcggtaaactttaccggtggtttaggggtaccgggggtacttaacgtttttaaccggtacccgggttacccccgggttacggggggtacccccgggttaaaaccccggttccggggttaccccgtacccccggttacccccgtacccccccgtaacccccgttacccccgtaaccccggtaaaaccccgggg

SEQ ID NO: 419059 - DNA, 571 bp, Homo sapiens
  misc_feature: GZ8MTXP02FMUHQ.21.78.H01.1.454.CMB.2.raw
  modified_base (443)..(443): a, c, t, g, unknown or other
  modified_base (481)..(481): a, c, t, g, unknown or other
  modified_base (488)..(488): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtccctgagactctcctgtgcagtctcgtgggttcgtcaggtggcgactacatgagcgtcggggtcccgccgaggcctccgaaggggaacgggcctggagtggatctgtactttatttatagtggtgtaccccacatacacacagactcgtgaaggccgatcacatctacagaaagacaattccgaagaacactattagtatccttaanaaatagaaataaccgtgaagacgcgagacacggcagtntattcgngtgtgggctatttcgtcgacccggtggggacccggtaaccgtggtaccaccggtcccaccccacccgaccctacggaacccgg

SEQ ID NO: 419060 - DNA, 635 bp, Homo sapiens
  misc_feature: GZ8MTXP02HNBJC.21.78.H01.1.454.CMB.2.raw
  modified_base (412)..(412): a, c, t, g, unknown or other
  modified_base (418)..(418): a, c, t, g, unknown or other
  modified_base (518)..(518): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttccttgttgctatttacaaaaggtgtccagtgtgaggtgcagttggtggagacgtggaggaggcttgatccgaggccggtcgggggtccctggacgactctcctgtgcagtctcgtgggttcgtcaggtggcgactacatgagcgtcgggtccgccgaggcctccgaggggaaggcctggagtggatcgtcactttattatagtggtggtaccccacatactacacagtactccggtagaacgggccattcacctanccctanaagaaagaacaacgttacaaaggaaacacgtatttagtacttactaacgaaatcgaaataacctgagacgacgacggacaacggcctatagtacttacgngttcggtggggacttaactttaccgttcggaacccccgtgggggtaccccgggaacccgttggtacccgaacccgttccccttacccccgaccccttacccgaacccgtaacccggg

SEQ ID NO: 419061 - DNA, 650 bp, Homo sapiens
  misc_feature: GZ8MTXP02F4A1N.21.78.H01.1.454.CMB.2.raw
  modified_base (350)..(350): a, c, t, g, unknown or other
  modified_base (367)..(367): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctacttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgaggggaacgggcctggaggtggatcgtcactttatttanaggtggtcggtacccanactactacacagactccgtagaacgggccgtattccactatctacagaagacaattccaagaaacactattagtatacttacaaatagaaataacctagagacggaccgaacgacgaccggcctaagtcgtaattacgttggtacggttacgggggtacttacgttttaaccgttccggtacccccgggtacgggggtaccccgggggtaaaccccgttcggtaccccgtaaccccggtccctaccccccgtacccgtacccccgacccgtaaacccccgggg

SEQ ID NO: 419062 - DNA, 658 bp, Homo sapiens
  misc_feature: GZ8MTXP02HDTMI.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgttaggtgtagttggtggagactggaggaggcttgatccagccgtgggggtccctgagactctcctgtgcagtctcgtgggttcgtcagtggcgactacatgagctgggtccgccaaggcctccgaggggaagggccctgggacgtggactctcgtaactttatttatagtgggtggtaaccactagtaccactacagacctccgtgacggggccgtattccaacctatcctacaagaaacgactaaacttcccaagggaacaacgtatttagaacttacttaacaaaagttcgaaaactaacccgttggaagacgggacccgaaggggaaccaacgggcccaaagtcgttaaattcgtagtgggtacggggtacctagtttacgtcggaaaccccggtgggggtaccccgggaaccctggtaccaacccggttcccaccccctacccgaccgaaccgaacgggcccctaacgg

SEQ ID NO: 419063 - DNA, 707 bp, Homo sapiens
  misc_feature: GZ8MTXP02HDZPD.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtcgggtccgccgaggcctccgaggggaacggccgtggagtggatcctactactttatttagtagtggtaggtaaccccacgtatacctacacaacgactccgggtaggaaacggggcccgtaattccaacccagttcctaccgaaagaaacgtacaaacgttcccgaaagggtaaacaccgtagtttacgtacttaccttaacaaaattaggaaaactaacccgttaggaacgacgggaccggaaggaccgacgggacctaagttgttaaacgtttacgtggttagggtacggggtacttaacgttttaaccgtccggtaacccccgggtcgggggaccccgggttaaacccctgggtaaccccgtaacccggtcccctacccccgacccttacccgaaccggaaacccccggg

SEQ ID NO: 419064 - DNA, 736 bp, Homo sapiens
  misc_feature: GZ8MTXP02JAGZ6.21.78.H01.1.454.CMB.2.raw
  modified_base (481)..(481): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagactgggaggaggcttgatccagccgtgggggtccctgagactctcctgtgcagtctcgtggttcgtcaggtggcactacatgaacgtgggccgccaggcctccgaggggaggcctggagtggatctctactttatttatagtggtacggtacctactactacctacaactagaccttcggtggaaacgggccgtaacttccaacctactcctacaaaggaaacgaacctaaacttacccgaaaggaaactacctagttttagtaacttccttaanaaaattcggtaaaaacttacccgtaggaagtacggacccgggaaaggtaacccgacggacctaaagtagttaaacgtttaccgttggtcggggttaggggtacctttaaacgtttttaccgtacccgggtaacccccggggttcgggggggaaacccccgggggtaaccctttccgggggtaaccctaacccccggttcccgtacccccccccgtaacccgttaccccggaacccccgaaacggggttacccccc

SEQ ID NO: 419065 - DNA, 681 bp, Homo sapiens
  misc_feature: GZ8MTXP02FOL1W.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcaggtggcgactacatgagcgtcgggtccgccgaggcctccggaaggggaacggggccgtggaggtggatacgtcactttatttagtaggttggttacggtaccccactagtacctactacacgacttccgggtagaacgggacccgtaattcccaacctattccacgaaaggaaacacaaactttccgaaaggaacaactattacgtatacttacaaaattacgaaataaaccgtgaaagacgaccggaaaggaaccacggacctagtagttaaacttcgtaggtggtacggggtattacgtttacgtaccggtacccccggggttacgggggaaccccggggttaaaccctcggggtcctaaacccgttccccgtacccccgacccctacccgacccgaaaccccgggg

SEQ ID NO: 419066 - DNA, 736 bp, Homo sapiens
  misc_feature: GZ8MTXP02HGRBA.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggttggtggagacgtgggaggaggcttgatccagccgtcgggggtcctgagctctcctgtgcagtctcgtgggttcgtcaggtggcgactacatgagcgtcgggtccgccgaggcctccggaaggggaacgggcccgtaggaggtggactcgtctactttatttagtaggtggtagtaccccacatacacacagactccggtagaacgggcctattccaccatcctacaagaaacgaactaacttacccgaaaggaaacctactaagtttacgtaacttacccttaaacaaaatttacggaaaacttaaacccgttggaaacgtacgggaccccggaaaggaccgaaccgggtcctaagtttacgttaactttacggtgggtttaggggtacgggggttacctttaacgtttttaccggttcccgggtacccccggggttacggggggaacccccggggtaacccttcgggggtacccctaaccccgggtttccccaaccccccgtacccccgttacccgaacccggtaaacccccgggg

SEQ ID NO: 419067 - DNA, 643 bp, Homo sapiens
  misc_feature: GZ8MTXP02IM9MB.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctctgtgcagtctcgtgggttctcgagtggcgactacatgagtcgtcgggtccgccgaggcctaccggaaggggaacggccgtggagtggatcgtactactttattatagtggtacgtacccacgatactacacacgactccggtagaacgggccgtaattacccgactacgtctacgaagaaacgaacaaacttccgaaaggaaacacgtattagtaactcttaacaaaatagtaaactaacgtagaagacggaccgaaggaccgtacggacctaagttacgtacttaacgtggttggtacggggtacttacgtttaacgtcggtacccggtcgggggtaacccggacccgtggtcctacccggtccctacccgacccgtacccgaaccgaacccgg

SEQ ID NO: 419068 - DNA, 714 bp, Homo sapiens
  misc_feature: GZ8MTXP02IP3EF.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcgagtggcgactacatgagcgtgggtccgccgaggctccggaggggaacggccgtggagtggatcctctactttatttatgtggtcgtacccactatacctacacacgtactccggtagaacgggccgtaattccaacatctacaagaacgaactaaacttccgaagaaacaccatttacgtaattacttacaaaagttagaaactaaacccgttgaacgaggaccccggagtaccgaacgggcctaagttacggttaattaccgttggggttagggtacgggggttacctttaaacgtttttacccggttaccggggtaaccccccgggtacgggggggttaccccccgggggtaaaacccgttccggggttccccgtaaccccggttcccccggtaccccccctaacccccgtttccccgaaaacccggtaaaccccgggg

SEQ ID NO: 419069 - DNA, 711 bp, Homo sapiens
  misc_feature: GZ8MTXP02FJLAS.21.78.H01.1.454.CMB.2.raw
  modified_base (361)..(361): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtggggtccgccaggctccgaggggaagggcctggagtggatctcactttatttatagtggtggtaccccanatactacacagactccgtgaaacgggtccgattccgaaccattaccctacaaggaaacgtaaactaaactttcccggaaagaaactactaagtttacgttacttacccttaaactaaaagttacgtaaaactttaacccgaaggaacggaaccgggacggaaaccgggaccgaaccgggtacccttaggttagttaaacgtttacgtagggttggggttacgggggactttaacgtttacgttaccccggtacccgggggttaccgggggccccggggtaaacccgttcgggtacccctaccgggttccccctccccctaaccccgtacccgaacccggtaaaccccggg

SEQ ID NO: 419070 - DNA, 823 bp, Homo sapiens
  misc_feature: GZ8MTXP02JGJ7O.21.78.H01.1.454.CMB.2.raw
  modified_base (307)..(307): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcgagttggtggagacgtgggaggaggcttgactccgaggccgtcgggggtccctgagactctctgtgcagtctcgtggttcgtcgaggtggcgactacagtgagcgtcgggtccnccgaggcctaccggaaggggacggccgtggagtggacttcgtacttactttagtttaagtaggtggtacggtaccccactaactactaaccacgaacgtaccgtccgggtacggaacgggggtaccctacgttacccaaccctacttcccgtaaacgaaacgggtaaacgtaaccctaaaaccgtttacccgaaaacgggtaaaacctaaccgttaaggttttacgtaactttaaccttaaactaaaaagttacggtaaaaaccttaaaccggtaggaaacgggtaaaccgggacccggaaaacgggacccgaaaccggggtacccttaaaggttaacggtttaaactttaccggtggggtttacgggggttacgggggtaacctttaacggtttttaaccgtacccggggtacccccggggtaaccggggggtaaccccgggtacccgttaacggtccccgtaccccggtacccctaccccccacccggttaacccccgacggtaaacccccggg

SEQ ID NO: 419071 - DNA, 700 bp, Homo sapiens
  misc_feature: GZ8MTXP02GH13X.21.78.H01.1.454.CMB.2.raw
  modified_base (510)..(510): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgaggccgtgggggtccctgagactctcctgtgcagtctcgtgggttcgtcagtggcgactacatgagcgtcggggtcccgaccgaggcctaccggaaggggaacggggcctaggggaggtggacttctactacttttaatttagtaggtggtacggttaaccccagtaactactaacacacggtacctccgggtagaaacggggcccgtattaccaacctatacctacgaaagaaacgaactaacgttaccgaaaggaaacactatttacgtattaccttaanaaaatagtaaacttaaccgtaggaacgacggaccgaaggaaccgacggacctaagtagtacgttagtggtgggtaggggtacttaacgtttaccgtaccggtaccccgggtacgggggaccccgggtaacccgtcggtcccaaccccggttcccctaccccccgacccgtacccgaacccggaaccccgg

SEQ ID NO: 419072 - DNA, 598 bp, Homo sapiens
  misc_feature: GZ8MTXP02FPGKU.21.78.H01.1.454.CMB.2.raw
  modified_base (346)..(346): a, c, t, g, unknown or other
  modified_base (469)..(469): a, c, t, g, unknown or other
  modified_base (571)..(571): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgccaggctccgagggacggccgtggagtggatctctactttatttanagtggtcgtaccccacatactacacagactccggtagaacggggcctattccaactagtctacaagtaaacgaacaaacttacccgaaaggaaacacctaattacgtactacttacaaaagtnaaaactaaccgtagagagccgaagacacgcatctatactggtcgtgggctatttaccgtcgacccgtcgggggcccggtaacccgtggtcccaccgttcccnccccgtaccctaccgacccaacccggg

SEQ ID NO: 419073 - DNA, 759 bp, Homo sapiens
  misc_feature: GZ8MTXP02HVWOQ.21.78.H01.1.454.CMB.2.raw
  modified_base (257)..(257): a, c, t, g, unknown or other
  modified_base (369)..(369): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtggggggtccctgagactctcctgtgcngtctcgtgggttcgtcaggtggcgactacatgagcgtcgggtccgccgaggcctccgaggggacggccgtggaggtggatctctactttattagtagtggtcggtaccccanactactacacacgactccggtaggaacgggcctacgttacgaaccctatcctacaaagaaacgaactaaacttacccgaaaggaaacaccttaattacgttaattaccttaactaaaagttaacgtaaaacttaaacccgttaggaagaaccgggacccggaaagggaacccggaacggtacccgtaacgtagttaacgtttaacgttgggttacggggttcgggggtacctttaacggttttaccggtttaccggtaacccccggggttaccggggggtacccccgggggtaaacccggttcccggggttaccccgtaacccccggtttaccccccgttaccccccgtaaccccccgttacccccggaaaccccggtaaaccccggggg

SEQ ID NO: 419074 - DNA, 736 bp, Homo sapiens
  misc_feature: GZ8MTXP02JCQNX.21.78.H01.1.454.CMB.2.raw
  modified_base (445)..(445): a, c, t, g, unknown or other
  modified_base (570)..(570): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtccgccgaggcctccgaggggaacgggccgtaggaggtgggtactccgtactactttagtttagtaggttggtacggtaccccagtactactacgacacgactccggtaggaacgggtccgtattccgacctatcctacaaggaanactaacgttccgaagaacctactaagtttagtacttactaacaaaagttacgtaaactaacccgttgaaacggtaccggaaccgacggaaccgacgggaccttaagtacggttaacgtttaccgnggttacgggtcgggggtactttaacggtttacccgttccggggtaacccccggttacgggggggaacccccgggttaaacccgtccggggtaccccgaccccggggtttaccccctacccccccgtaaccccgtttaacccccggtaaccggtaaaccccccgggg

SEQ ID NO: 419075 - DNA, 594 bp, Homo sapiens
  misc_feature: GZ8MTXP02H3PC5.21.78.H01.1.454.CMB.2.raw
  modified_base (396)..(397): a, c, t, g, unknown or other
  modified_base (399)..(399): a, c, t, g, unknown or other
  modified_base (403)..(403): a, c, t, g, unknown or other
  modified_base (431)..(431): a, c, t, g, unknown or other
  modified_base (444)..(444): a, c, t, g, unknown or other
  modified_base (460)..(460): a, c, t, g, unknown or other
tcagtcgtcgctcgcacgaccggtgctcgatttagtgtgagtagtttgggtttgggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtcctgagactctcctgtgcagtctcgtgggttcgtcaggtggcgactacatgagcgtcgggtccgccgaggcctccggaggggacgggcctaggaggtggactctctacttattatagtggtagtacccacactacacacagactcgtgagccgatcacnncnaganacaataccagaacactatgtactctaanaaatgaaactacngtacgagaccgagacncgacatcgtaatacgtgttacggtcgggtacttacgtttaaccgccggtaccccggtgggggtacccccggtaaccgtcggttaccccacccggtccctacccccgacccccgtaccgaacccggtaacccggg

SEQ ID NO: 419076 - DNA, 774 bp, Homo sapiens
  misc_feature: GZ8MTXP02FTW1R.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacagtggagcggttcggggtcccgaccggacggccgtaccggaagggggaacggggtccggtaggaggtgggacttccgtactaacttttaagtttaagtaggttcggggttacggtaacccccactaactaacctaacaacgaacgtaccgtccggtagggaaacgggtccgtaacttaccaacctactcctaacaaggtaaaacgtaactaaacttacccgaaaggaaaccctaacttaagtttagttaacttaccttaacaaaagttagaaaaccttaccgtaggaacggtaaccggaccggaacgggaaccaccgggtacctaagttacgttaaattccggtagggttgggtacgggtaactttacgttttacccggtaccgggacccccggggttacggggggacccccgggtaaaccgttccgggtaccccttacccggtaccccctacccccccgacccgtaacccgaaccggtaaacccccggg

SEQ ID NO: 419077 - DNA, 943 bp, Homo sapiens
  misc_feature: GZ8MTXP02IRVPX.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctattcaaaggtgtcagtgtgaggtgcagttgggtggagacgtgggaggaggcttgatccagccgtggggggtccctgagactctcctgtgcagtccgtggtcgtcgagtggcgactacatgagcgtcggtccgccgacggcgtccgaggggaacgggccggtcgggaggtggtagtcctttacgtaccgtttaattttagttaggtggggttacgggttacccaacccgtaacttaacctaacctaaccaacgtaacccgttacccggtacggggaaacggggtacccggtaacgtttacctaaccctaacgtaccttaccaaacgggaaacgtaaaccctaaaccttaaccgtaaacccgggaaactaaaccctagttttaaggtttaacttaaccgtttaaccttaaaaagttaagttaaaacccgttaaaaccgttacccgggtaaaggtaacccgggaacccgggaaacccgggaaacccgtaacccggggacccgtaaacgtttaaggttacgttttaaaaccgtggggttaaggtttaccgggggggtaacgttaaacccttttttaacccggggttttaaccgggtaaaccccccccgggggttaccccgggggggggttaacccccgggggtaaaacccccccggggttttacgggtaacccccgggttaaaaccccccggtttcccccctaaaccccccccggttaaaacccccccccgtacccccggttaaaaccccggggaaacccccgggggtttaaaccccccccgg

SEQ ID NO: 419078 - DNA, 698 bp, Homo sapiens
  misc_feature: GZ8MTXP02GSPTL.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcgagtggcgagtacagtgagcgtcgggtccgccgaggcctaccggaaggggaacgggccgtgggagtggatcgtactactttatttagtaggtggtcggtacccactatactacacgacgactccggtagaacgggccgtattccactactctacgaaacgaaacgaactaaacgttaccaaaggaaacaactaattacgttaacttaccttaactaaaattacgtaaaacttaaccgtagaaacgacggaccgaacggaaccgaacggccgtaaagttcgttaagtttaaccgtggttacgggtacgggggtactttaacggtttaccgttacggtacccccggtaccgggggtaccccggggtaacccgtcggtaccctaacccgtcccctaccccgtaccccgtaccccgaaccgtaacccccggg

SEQ ID NO: 419079 - DNA, 664 bp, Homo sapiens
  misc_feature: GZ8MTXP02IFMKE.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagctctcctgtgcagtctcgttgggttctcagtggcgactacatgagcgtcgggtccgccgaggctccgagggaggcctgggagtggatctactatttatttatagtggtacgtacccactatactacactagacctccgtagaaacggggcctaattccaccatctacagaaacgaacaacttaccgaagaactaacgtatttagtaacttacttaacgaaaattgaaacttaaacgtagaacgacggaccgaggacgacggctaagtagttacttaacgtggtagggtcggggtacttaacttttaccggaccggttaacccccgggtcgggggtaccccgggtaaacccgttccggggttaccctaaccccggttcccctaccccccgtacccccttacccgaaccccggtaaacccggg

SEQ ID NO: 419080 - DNA, 630 bp, Homo sapiens
  misc_feature: GZ8MTXP02HDY9R.21.78.H01.1.454.CMB.2.raw
  modified_base (298)..(298): a, c, t, g, unknown or other
  modified_base (356)..(356): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgcagtggcgactacatgagctgggtccnccaggctccgagggaaggcctggagtggatctcacgttattagtagtggtgtacccanatactacacagactcgtagaaagggccattcacatctacagaaacgacaaacttcccaaggaaactacaagtttagtaattaccttaaaacgaaaatacgaaaactaaccgtagaacgacgaccgaacggaccacggactaagttagtaacgttacgtggtacggtacgggtacttaacgtttaccgtaccgggtaccccggtacgggggacccggtaacccgtcggtacccgtacccgtcccctaccccgtacccacccgaaaccgaaccggg

SEQ ID NO: 419081 - DNA, 767 bp, Homo sapiens
  misc_feature: GZ8MTXP02JZSC6.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtcggggtcccgccgaggcctccggaggggaacgggccgtggagtggacttctactactttatttagtaggtgggtacggtacccccagtataactaacacgacgaccttcccgggtagggaaacggggcccgtattacccaaccctaatccctaacgaaacggaaacgtaaccctaaacgtttacccgaaacgggtaaacccaccttaagttttacggtaaactttacctttaaaccaaaaacgttaggtaaaacttaaaacccgttggaaacggtaaccgggaccccggaaacgggaaccgttaaccgggaccctaattacgttaatttacgttgggttaggggtacggggtacttaaacgttttaccgtcccgggtaccccggtaccggggggtacccccgggtaaacccggtcggtaccccgtacccggttccccctacccccgtaccccgtaccccgaccgtaaccccgggg

SEQ ID NO: 419082 - DNA, 550 bp, Homo sapiens
  misc_feature: GZ8MTXP02G21KQ.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctctgggttcgtcagtggcgactacatgagctgggtccgccaggctccgaggggaaggcctggagtggatcgtcactttatttagtagtggtggtaccccacatactacacagactccgtgaaacggggccattcaactatctacagaaagacaataccagaaacactattgtatactacaaatgaaatactgagagccgagacacggcatcgtatactgtgtgggtctagtttacgtcgacccgtcggggaccgggaacctggccaccgtctccccacctccacgaaccgg

SEQ ID NO: 419083 - DNA, 754 bp, Homo sapiens
  misc_feature: GZ8MTXP02HX30H.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtcagtgtgaggtgcagttggtggagacgtgggaggaggcttgatccagccgtgggggtcctgacgactctcctgtgcagtctcgtgggttcgtcgagtggcgactacatgagcgtcgggtccgccgaggccgtccggaggggaacggggccgtggaggtggactcgtactactttatttagtaggtggttacggtaccccataattacaacacgtacgaccttcggtagggaaacgggccgtacttaccacctatcctacgaagaaacgactaaacgttacccgaaagaaactaacctagtttacgtactttacttaaacgaaattaagaaaactttaacccgtagaaacggacgggtaccccggaaagggaacccgaccggggtaccaagttaggttaactttaaacggttggggttcgggtttacgggggtaacctttaacggttttaccggttaccccggaacccccgggggttcgggggaacccccggggtaaaccgttccggggtacccctacccgggttccccccttaccccccgaccccgttacccccgaaaccggtaacccccgggg

SEQ ID NO: 419084 - DNA, 695 bp, Homo sapiens
  misc_feature: GZ8MTXP02IT85R.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccgagccgtgggggtccctgagactctcctgtgcagtctcgtgggttcgtcaggtggcgactacatgagccgtcggggtccgcccgaggccgtaccggaaggggaacggggccgtagggaggtggattcctcgtactttatttagtaggttggtacgtacccacatactacacagactccgtagaagggcccgatttccacctatctacgaagaaacgtaaccaaattacccgaaggaaacacgaatttagtactacttaacaaaatacgtaaaataacccgtagaacggacggaccggaacggaaccgaccggactaagtacgttaattacgtggttaggtcggggacttaacgtttaccgttaccggacccccgggtaccgggggtacccccgggggtaaaccccgtcggtaccccgtaacccccgttcccgtaccccccgtaccccctacccgaaaccccgtaaccccggg

SEQ ID NO: 419085 - DNA, 615 bp, Homo sapiens
  misc_feature: GZ8MTXP02IH9C8.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcagtggcgactacatgagcgtcgggtccgccgaggcctccgaggggaggccgtggagtggatctctacttattagtagtggtacgtaccccacatactacacagactcgtagaagggccattaccacatctacagaagactaataccgaagaacactattagtactactacaaatagaaataacctagacgagaccgagacacggacagtagtagttacgtggttggtggggtacttacgtttaccgtaccggtaccccgggtacgggggtacccgggtaacccgtaacgggtcccgacccgttacccctacccccgtacccctacccgaacccgtaaacccggg

SEQ ID NO: 419086 - DNA, 646 bp, Homo sapiens
  misc_feature: GZ8MTXP02HH8LU.21.78.H01.1.454.CMB.2.raw
  modified_base (471)..(471): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtccgccgaggcctaccggaaggggaaacgggcccgtagggaggtggaatctactaattatttaataggtggtaggtaaccccacaactactaacaacacgactccggtaggaacggccgtattcaccatcacagaaagaacaactaccaagaacactattatattaccttaaanaaatagtaaataacgtagagacggacgaacggacgacggtacaagtagtaattacgtaggtcggtacgggtactaacgtttacgtaccggtaccccgggtcgggggtaacccgggtaaccgtcggtacccgtaccccgtacccctacccccacccctacccgaacccgaacccgg

SEQ ID NO: 419087 - DNA, 670 bp, Homo sapiens
  misc_feature: GZ8MTXP02H5DSI.21.78.H01.1.454.CMB.2.raw
  modified_base (409)..(409): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagacctctcctgtgcagtctcgtgggttcgtcaggtgcgactacatgagcgtcgggtcccgccgaggcctccgaggggaagacgccgtggagtggtactcgtactactttaatttagtagtggtcgtaccactatactacacagcgtcgagacggccatcacatcanagacgactaactcgaaagacactagttagacttactaacaaattacgtaaaacttaaccgtaggaaggaaccgaccggaaacggtaccgaccgggacctaagttagtaactttaaccggtgggttacggtagggggtacctttaacgtttaccgttcccgggaaacccccgggttcggggggtaccccggggtaacccgttcggggtaccctacccccggttccccgtacccccccgtacccgtaaccccgaaacccccgg

SEQ ID NO: 419088 - DNA, 631 bp, Homo sapiens
  misc_feature: GZ8MTXP02INPMU.21.78.H01.1.454.CMB.2.raw
  modified_base (414)..(414): a, c, t, g, unknown or other
tcagtcgtcgctcgcacgaccggtgctcgattagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggcttgatccagccgtgggggtccctgagactctcctgtgcagtctcgtgggttcgtcgaggtcggcgactacatgagcgtcgggtccgccgaggcctccgaaggggaacgggccgtaggaggtggactctactactttatttagtagtggtcgtacccacatactacacagactcgtagaacggctatccacatctanagaaacgactaactaccgaagtaaaccactattagtaacttactaactaaaactagtaaactaaacctggaacgacgaccggaagaccgacggcctaagtacgttattacgtggttaggtgggtactacgttttaccgtcggtaccccggtcgggggacccggtacccgtcggtcccgtaccctcccgtcccctaccccgtaccaaccgtaacccgg

SEQ ID NO: 419089 - DNA, 591 bp, Homo sapiens
  misc_feature: GZ8MTXP02GOSZA.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgaggggaagggcctggagtggatctcactttatttatagtggtggtacccacatactacacagactccgtagaacgggccgattcacatctacagtaaacgacgaattccaggaaacacattgtaatcttacaaatagaaataacctagagagccgaggacacggccaatgtatactggtagtggggactacgtttactcggtaccccgtcgggggacccgggggtaaccctcggggttccaacccggttcctacccccgaccccttacccgacccgaaacccggg

SEQ ID NO: 419090 - DNA, 585 bp, Homo sapiens
  misc_feature: GZ8MTXP02GEHZR.21.78.H01.1.454.CMB.2.raw
  modified_base (299)..(299): a, c, t, g, unknown or other
  modified_base (363)..(363): a, c, t, g, unknown or other
  modified_base (447)..(447): a, c, t, g, unknown or other
  modified_base (461)..(461): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgtgggttcgtcagtggcgactacatgagcgtgggtccnccgaggctccgaggggacggccgtggagtggatcgtctactttatttatagtggtcgtacccanatactacagacgactcgtagaacgggccgacttcacatctacaagaacgactaactccaagaaccagtattacgtatacctaanaaattagaaatacngagagcgaagacacgccagtgtactgtacggtgtcgggattacgtttacgccgtaccccggtcgggggtaccccggtaactcggtccctaccgtcccgaccccctaccacccgacgtaacccgg

SEQ ID NO: 419091 - DNA, 783 bp, Homo sapiens
  misc_feature: GZ8MTXP02IZXBI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtccctgagactctcctgtgcagtctcgtgggttcgtcaggtggcgactacagtgagtcgtcgggtccgccgaggcctccggaggggaacggggcccgtgggaggtcggattccgttctaacttttagtttaattaggtcggtacggtaccccactaattaactaacaacgacgtacctccggtaggaaacgggggccgtaaactttccaacctagttacctacaaacgtaaaacgaacctaaagttaccccgaaagggtaaaaccctaccgttaatttacgttaacttacccttaaactaaaaagttaacggtaaaaccttaaacccggtttaagaacgggtaaacgggacccccggaaaggaaacccgtacccggggacctaaggtttaaggtttaacttaaccgggtggttccggtagggggtacctttacgttttaaccgtaccgggtacccccggggtagggggtacccccgggaaaccggttaacggtcccggtaaacctcccccggtaccccctaccccgtacccgaaacccgtaacccggg

SEQ ID NO: 419092 - DNA, 719 bp, Homo sapiens
  misc_feature: GZ8MTXP02HK4M3.21.78.H01.1.454.CMB.2.raw
  modified_base (560)..(560): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcgtgggttttccttgttgctatttacaaaaggtgtccagtgtgaggtgcagttggtggagacgtggaggaggcttgactccgagccgtgggggtccctgagactctcctgtgctagtctcgtgggttcgtcaggtggcgactacagtgagtcgtcgggtccgccgaggcctaccggaaggggaacggccgtggacggtaggactctctactttatttagtagtggtacgtacccatactactacacacgactccgaggaacgggcctattccaacgtatcctacgaaagaaacgaactaacgttacccaaaggtaaaccactagtttaactaacttacttaacaaaagtcgtaaaacttaaccgtggaacgacggaccggaagaccgacgggacctagttacgtaactttacgngggttacgggtacggggtactttaaacgtttacccgggtccgggtaaacccccggggttcggggggaacccccggggttaaacccgttcgggtaacccgtacccccgttacccccggttaccccccaccccggtaccccgaaacccgggtaaaccccgg

SEQ ID NO: 419093 - DNA, 626 bp, Homo sapiens
  misc_feature: GZ8MTXP02JTO11.21.78.H01.1.454.CMB.2.raw
  modified_base (386)..(386): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtggttcgtcaggtggcgactacatgagcgtgggtccgccgaggcctccgaggggacggcctaggagtggatctactactttatttataggtggtaggtaccccatatactacacagactccgngaacgggcctatccacatctacagaaagactaactaccgaagaacactattagtattacttactaaaatgtaaactaacctagaagacggaccgaacggaaccgaccggacctagtgtaacttacgtggtaggtggggtacttacgtttacgttcgtaccccggtcgggggtaccccgggtaaccgtcggtcccgtacccgtccctacccccgaccccgttacccgaacccgaacccggg

SEQ ID NO: 419094 - DNA, 583 bp, Homo sapiens
  misc_feature: GZ8MTXP02HDH3V.21.78.H01.1.454.CMB.2.raw
  modified_base (371)..(371): a, c, t, g, unknown or other
  modified_base (398)..(398): a, c, t, g, unknown or other
  modified_base (501)..(501): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctgggggggtccctgagactctcctgtgcagtctctgggttcgtcagtggcgactacatgagctggggtccgccaggctccaggggaaagggcctggagtggatcgtcacttatttatagtggtggtacccacatactacacanactccgtgaaaggccgattcaccatcncagaaagacaattccaagaacaacattagtatacttacaaaatagaaataaaccctagaagacggaccgaggaacacggaccaatgtataactgtgtgggggntacttaactttcgaccccgtggggcccggggaaacccgtcggtcaaccggtcctacccccacccctcccaaccaaacccggg

SEQ ID NO: 419095 - DNA, 756 bp, Homo sapiens
  misc_feature: GZ8MTXP02IQO6F.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgaactacatgagcgtgggtccgccgaggcctccggaggggaacggggccgtgggaggtggatcgtctaactttatttataggtggtcggtaaccccacatactacacgagactccggtggaaacgggccgattccactactctacgagaaacaacaaacttccgaaaggaaactaccgtatttagtaacttaccttaacaaaattacgaaaacttaaacccgtaggaacggaacggaccccggaaaggaacccgaaccggggacctaaagttaggtttaaactttacgttaggttcggggtacgggggttacctttaaacgtttttaaccggttacccgggtaaccccccggggttcgggggggtaacccccgggggttaacccggttaacccggggttaacccggtacccccggtttacccccgttacccccccgtaacccccgtttacccccgaaaccccgggtaaacccccgggg

SEQ ID NO: 419096 - DNA, 711 bp, Homo sapiens
  misc_feature: GZ8MTXP02HK5N0.21.78.H01.1.454.CMB.2.raw
  modified_base (323)..(323): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgcttatttacaaaaggtgtccagtgtgaggtgctaggttggtggagacgtgggaggaggtcttgatccgagccggtcgggggtcctgacgctctctgtgctgtctcgttgggttcgtcgtaggtcggcgactacagtggacgtcggtcgggtcccgaccgnggccgtaccgggaaggggaacgggccgtagggaggtcggtacttccgttacttactttagtttagtaggtcggtacgtacccctaactactacctaacacgacgtaccgtccggtacggaacgggtacctacgttacccaactacgttacaaccgaaagtaaaccgtaactaaaccgttacgaaacgtaaacctacttagtttagtaacttacgttaaactaaagttacaaactttaccgagacgacggacgacgacacgctagttagtactgtacggtgggtacggtacttacgtttcggtaccggtaccccgggtcgggggaacccccggtacgttccgacccgtccccgtcccctacccccacccgtcccgaaaaccggtcccgg

SEQ ID NO: 419097 - DNA, 734 bp, Homo sapiens
  misc_feature: GZ8MTXP02JRUHP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtgggaggaggtcttgactccgaggtcccggtcggggggtccctggacgactcctcctgtgctagtctcgttggggttcgtcgaggtggcgactacgagtggacgtcggtcggggtcccgccgaggcccgtacggaaggggtaacggccgtagggaggtgggacttctacgtatttagttagtaggtggtacgtacccactataacctacacacgtacgtcccggtaggaacgggtccgtattccaaccgtatcctacgaaagaaaccgtaactaacgttaccgaaacgtaaacctactaagtttaactacttacttaaactaaaatacggtaaactaacccgtaggaacgacggaaccgggaacgaccgtaaccggtctaagttcgttaacgttaggtaggtgggtacggggtactttacgttaccgttccggtaccccggggtaccgggggtcccgggtaaaccgtcggggtcccctaaccggtcccctacccccggacccctaccgaacccgtacccggg

SEQ ID NO: 419098 - DNA, 765 bp, Homo sapiens
  misc_feature: GZ8MTXP02GDQZT.21.78.H01.1.454.CMB.2.raw
  modified_base (483)..(483): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatggagcgtgggtccgccgaggcctccgaggggaacggcgtggagtggatctctactttatttatagtcgggtacggtaccccacagtaactacacgacgtactccggtaggaacgggccgtattccacatcctacaagaaacgaactaaacgttacccgaaaggaaaccacgtaatttacgtaattacccttaaanaaaacgttaagtaaaacttaacccgttaggaacgaaccgggaccggaaacggtaaccggaaccgggaccctaaagttacggttaaacgttttaccgtaggggttacgggttacgggggtacctttaaaccgtttttacccgggtaacccgggtaccccccgggttaccgggggggaacccccgggggttaaaacccccgttcgggtaaccccgtaaccccgggttaccccctaacccccccgtaccccccgttaacccgtacccccggtaaaaccccggggg

SEQ ID NO: 419099 - DNA, 620 bp, Homo sapiens
  misc_feature: GZ8MTXP02GEZLR.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgccaggctccgagggaggcctggagtggatctctactttatttagtagtggtacggtaccccacgatactacacacgtactccgtgaacgggccgattccactatctacagaaagaacaattccaagaacactattgtaacttctacaaatgaaataacctagagagaccgaagacacggcctagtcgtattacgtgttggtcggggctaacgtttacgttccgtaaccccgggtcgggggtaccccggggtaaacccgttcggggttacccaacccgggttcccctaccccccgaacccctccccgaacccgtaaaccccgggg

SEQ ID NO: 419100 - DNA, 592 bp, Homo sapiens
  misc_feature: GZ8MTXP02IH6AY.21.78.H01.1.454.CMB.2.raw
  modified_base (503)..(503): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgcagtggcgactacatgagcgtgggtccgccaggcctccgaaggggacggccgtggaggtggactctctactttattatgttaggtcggtaaccccacgatactaacactacgactccggtagaaacgggcccgattaccacatcctacaagaaagacaattccaaagtaacaactattagtatacttacaaatcgaaataactgagagccgagacaggcatgtatacgtgtaggngggtactactttacgtcgaccccgtacgggggccggtaaacccgtggtcccaacccgttccacccccgtacccgtccaacggaacccgg

SEQ ID NO: 419101 - DNA, 619 bp, Homo sapiens
  misc_feature: GZ8MTXP02F7LE5.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtcccgccgaggcctccgaggggaacggcctggagtggatctcactttatttatagtggtcggtacccacatactacacagtactccggtagaaacggggccgattccaaccatcctacaagaaacgacaaacttaccgaaggaacactattagtactacttacaaatgaaactacctagaagacgaccgaggacacggccatagtatacgtgtggtgggcttacgtttaccgttcgaccccggtacgggggccccggggtaacccgtcggtcccgaccccgttcccgaccccccgtaccccgtacccgaacccgtaaccccgggg

SEQ ID NO: 419102 - DNA, 684 bp, Homo sapiens
  misc_feature: GZ8MTXP02F6QPM.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctctgtgcagtctcgtgggttcgtcaggtggcgactacatgagcgtcgggtccgccgaggcctaccggaaggggaacgggccgtggagtggatctactactttattataggtggtacgtaacccactactaactacacacgacctccgggtaggaaacgggtccgtacttaccaacctattacctacaaacgaaacgtaaacctaaacttacccgaaaaggtaaaccaactaagttaacgtacttacttaactaaaatacgtaaaactaaccgtagaagacggaccggaacgaaccgacggactagtagtaacgttagtggtggtacggtacgggttactttaccgtacggtaccccggtacgggggacccggtaacccggtcggtacccgtacccgtccccgtacccccgtaccccgtaccccgaaccgaaccccggg

SEQ ID NO: 419103 - DNA, 804 bp, Homo sapiens
  misc_feature: GZ8MTXP02JI1CT.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagtcgttgggttttccttgttgcttattacaaaggtgtccagtgtgaggtgcgtaggttgggtggagacgtgggaggaggtcttagactccgacggtccgggtcgggggtccctggacgtccttctccgtgtcgctacgtcgttcggttcgggttcgtcgtaggtcggacgtactactagtgacggtcggttccgggccctaccggaggcccgtaccggggaaggggaacggtccggtagggacggttggtacgttaccttactttaacgtttaagtttaggttacggtacgggttaccgtaaccccgtactaactaacctaacaacgacggtaccgtcggggtaaggaccgggtacctacttaccaactcgtacctaaacgaaaggtaaaccctaactaacgttaaccgaaaggttaacctattaacttagtaacttaacctaataaaggtactaaactacgacgggaacgcgggaaccaacggactccgggtaacttaggtacgtttaactgggttacggtacggggttacgttacttaaaccggtttccgtaacccggggtccccgggggttaacggggacccccggtaccgtcgtacccccgtaaccccggttccccacccccgtaaacccggtccccggaaaacgtcccccggg

SEQ ID NO: 419104 - DNA, 592 bp, Homo sapiens
  misc_feature: GZ8MTXP02H0NJE.21.78.H01.1.454.CMB.2.raw
  modified_base (409)..(409): a, c, t, g, unknown or other
  modified_base (439)..(439): a, c, t, g, unknown or other
  modified_base (465)..(465): a, c, t, g, unknown or other
  modified_base (493)..(493): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtgggagactggaggaggcttgatccagccgtggggggtccctgagactctcctgtgcagtctcgtgggttcgtcagtggcgactacatgagctgggtccgcaggctccgaggggaacgggccgtggagtggatctctactttatttatagtggtcggtacccacatactacacagtactccggtaggaaacggccgattccaccatcncaagaaacgacaatcccaagaaacacattntatcttacaaagtcaaatacgtaganacgacgagacacggccagtgtaactagngttggacggggtctaatttaccgtcggaccccggtgggggccccgggtaacccgtggtacccacccggtccctcccccacccctccaacccgtaaccgg

SEQ ID NO: 419105 - DNA, 587 bp, Homo sapiens
  misc_feature: GZ8MTXP02JOOTQ.21.78.H01.1.454.CMB.2.raw
  modified_base (561)..(561): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtccgccaggcctccgaggggaggcctgggagtggatctctactttagtttatgtggtggtaaccccacatactacgacacgtactccggtagaacgggccgattccgactatctacagaagacatacaggaacacgattgtaactctttaacaaatagaaataacctgaagacgacgaggacacggccatgtatacgtgtcgtggggactacgtttacgtcgtaaccccgtcgggggcccggaaccttcggccgtacccgtccncccccaccgtacccgacgtaacccgg

SEQ ID NO: 419106 - DNA, 563 bp, Homo sapiens
  misc_feature: GZ8MTXP02FX7XU.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagttgggtcccgccgaggcctccaggggaaggcctgggagtggatctcacttatttatagtggtggtaccacatactacacagacctcgtgaagggccgattcaccatctacagaagacaattccaaggaacacattgtatctacaaatgaaatactgagacgacgaggacacggcatgtatactgtgtacggggctagttaccgtcgacccgttcgggggaccggaaccctggtccgcccgtctacccccaccctaccgacccgacggggtacccc

SEQ ID NO: 419107 - DNA, 676 bp, Homo sapiens
  misc_feature: GZ8MTXP02F7N49.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtcccgccgaggcctccggaggggaacggccgtggagtggatctctactttatttagtagtggtcgtaccccatactacacacgacgactccggtagaacgggccgtattccgactatctacaagaacgaacaaacttaccaaggaacactattacgtatacttacaaaatgaaacttaaccgtgaagacggaccgaaacggaccgaacggtcccaagttagttaactttacgtggttacgggtcggggtacttaacgttttacccggtacggtacccccggggtacgggggtacccccggggtaaacccgtcgggttaccccgaccccggttaccccctacccccggtaaccccttacccgaaaccccggaaccccgggg

SEQ ID NO: 419108 - DNA, 569 bp, Homo sapiens
  misc_feature: GZ8MTXP02FOQHL.21.78.H01.1.454.CMB.2.raw
  modified_base (448)..(448): a, c, t, g, unknown or other
  modified_base (485)..(485): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagcgtgggtccgccaggcctccgaggggaaccggcctggagtggatctcactttatttatagtggtggtaccccactatactacacagactccgtgaacgggccattccacatctacagaaagacaattaccaaggaaaccactattagtatcttacaaatnaaatacctgagacgccgagacacggcatgtattacgngtggtggggctatttactcgaccccgtcgggggcccgggtaaccctggtccaccgtccctccccgaccctcccaccgtaaccgg

SEQ ID NO: 419109 - DNA, 733 bp, Homo sapiens
  misc_feature: GZ8MTXP02G5HU7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcggggtcccgccgtaggcctccggaaggggaacggggtcccgtagggaggtggatctacgtactttatttagtaggtggtaggtaccccacgtatactaacacagactccggtaggaacggggcctattccactactcctacaagaagactaaacttaccgaaggtaaactaaccgtatttacgttaacttacttaaactaaaattagtaaaacttaacccgttagaacgtaacgggaccggaaacggaaccgaccgggacccgtaagttaagtactttaaagtcggttagggttacgggggtattacgttttaaccggtacccggtaccccggggttaccgggggtaccccggggtaaaaccccggttcgggtaaaccccgtaccccggttccccgtaccccccaaccccgttaccccgaaaccccggtaaaccccgggg

SEQ ID NO: 419110 - DNA, 589 bp, Homo sapiens
  misc_feature: GZ8MTXP02H9F2I.21.78.H01.1.454.CMB.2.raw
  modified_base (366)..(366): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctctgggttcgtcagtggcgactacatgagcgtgggtccgccaggcctccgaaggggaagggccctggacgtgggatctcactttatttatagtggtgtaccccanatactacacagactccgtgaagggccgattcaccatctacagaacgaacaattccaaggaaacacattagtatcttacaaattgaaactaacctgagacgaccgagacacggccatcgtatacgtgtacggtggggctacgtttaacgtcgacccggtcgggggcccgggaacccgtcggtcccacccggtccctacccccaccctacccgaccgaacccggg

SEQ ID NO: 419111 - DNA, 664 bp, Homo sapiens
  misc_feature: GZ8MTXP02IEI6F.21.78.H01.1.454.CMB.2.raw
  modified_base (449)..(449): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtccctgagactctcctgtgcagtctcgtgggttcgtcagtggcgactacatgagcgtgggtccgcgaggcctccgagggacggccgtggcgtggactctctacttatttatagtggtcggtaccccacatactacactacgactccgttagaacggggcctagttccacagtctacagaacgacaacttccaagacactatttacgtatacctanaaaacttgaaactaaccgtagagacgaccgaggaccaacggccaagtagttacttacgtcggttaggtacggggtacttaacgttttaccgtccggggttaacccccggtacggggggtacccccggggtaaaccccggttcggttaccccgtaaccccgggtttccccctacccccctacccccgttaccccgaaaccccgtaaaccccggggg

SEQ ID NO: 419112 - DNA, 603 bp, Homo sapiens
  misc_feature: GZ8MTXP02JWNPC.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtccgccaggctccgagggaggcctggagtggatctcacttatttatagtggtgtacccacatactacacagactccgtagaagggccgattccaccatctcagaagacaatccaagacacattgtatcttacaaatgaaatacctgagagaccgagacgacggcatcgtatacgtgtcggtggggctacgtttacgtcggtaacccccgtcgggggtacccccggggtaacccgtcgggtacccgtaacccccgggttcccctacccccccgtacccccgttaccccgaacccggaaacccccgggg

SEQ ID NO: 419113 - DNA, 688 bp, Homo sapiens
  misc_feature: GZ8MTXP02I20C3.21.78.H01.1.454.CMB.2.raw
  modified_base (416)..(416): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccaggccgtgggggtccctgagactctcctgtgcagtctcgtgggttcgtcagtggcgactacatggagcgtgggtcccgccgaggctccggaggggaacgggcctgggagtggatccgtcactttattatagtggtcggtaccactatactacaacacgactccggtaggaaacgggccgtattccaacctntcctacgaagaacgaactaaactaccaaggaaactacatttagtacttacttaacaaaattacgtaaaataaccttaggaacgacggacccgaacgggaaccgaccggtaccctaagtacgtttaaacgttacgttggttcgggttacgggggctttaacgttttacggttaccggtacccccgggttacgggggtaccccggggtaacccggtcggtacccgtacccgtcccctaccccccgaccccgtacccgaacccgtaaccccgggg

SEQ ID NO: 419114 - DNA, 784 bp, Homo sapiens
  misc_feature: GZ8MTXP02H2BAD.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtcctgagactctcctgtgcagtctcgtggttcgtcaggtggcgactacatgagcgtcgggtcccgccgaggcctaccggaaggggacgggccgtgggaggtggacttctactaactttagttagtaggtggtacggtaccccatactactacacgacgtacctccgggtaggaacgggcccgtattccaccattcctacgaaagaaacgaactaaacgttacccgaaagtaaacctaactaagtttacgtaaacttccttaaactaaaaattacggtaaaaacttaacccgttaaggaaacggtacccgggaaccggaaaccgggaaccggaaccgggtaccctaaagtttacggttaaacgtttaacggttggggttacggggttacgggggttacctttaaacggttttacccggttacccgggtacccccgggggttacggggggtaacccccggggtaacccggttaaccggggtaccctaaccccggttccccctaaccccccgtacccccgttacccgaaaaccccggtaaccccgggg

SEQ ID NO: 419115 - DNA, 756 bp, Homo sapiens
  misc_feature: GZ8MTXP02JI2B9.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgctagttgggtggagacgtgggaggaggcttgatccaggccgtgggggtccctgagactctcctgtgcagtctcgtgggttcgtcagtcggcgactacagtgagcgtcgggtcccgccgagggcctccggaaggggaacggggccgtagggaggtgggtactcctactacttttatttagtaggtaggtcggtacccctactactacctaacacgtacgacgtcccggtaggaacgggtccctagttccaaccgtatcctaacgaagaaacacctaaacgtttacccgaaaggtaaaccacgttaagtttacgtaaacttaccgttaaactaaaaagtcgtaaaaacgttaacccgttaggaaacgaccggaccgggaaacgaccgaaccggggaccttaagttacggttaaacgttacggttgggttacgggttacgggggtactttaaaccggttttacgtaccggggtacccccggtacggggggtacccccggtaaaccggtcggtaccccgtaaccccggtcccgtacccccaccccgttacccaacccggtaaccccggg

SEQ ID NO: 419116 - DNA, 639 bp, Homo sapiens
  misc_feature: GZ8MTXP02HWL9S.21.78.H01.1.454.CMB.2.raw
  modified_base (258)..(258): a, c, t, g, unknown or other
  modified_base (430)..(430): a, c, t, g, unknown or other
  modified_base (465)..(465): a, c, t, g, unknown or other
  modified_base (510)..(510): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttgggtggagacgtggaggaggcttgatccagccgtgggggtccctgagactctcctgtgcngtctctggttcgtcagtggcgactacatgagcgtcgggtccgccgaggcctaccggaggggaacgggccgtggaggtggatctactactttattagtaggtggtagtaccccactactactacacacgactccggtaggaacgggaccgtattaccacactctacaagaaanacaatacccgaagaaccattattgtacttcttaanaaatagaaatactagagacgacgagaccacggcagtgtacttagnggtacggtcgggtacttaacgtttaccgtaccggacccccggggttcgggggacccccggttacccggtaacgggtaccccacccggttcccccacccccgttacccccacccgaaaccccggacccgg

SEQ ID NO: 419117 - DNA, 690 bp, Homo sapiens
  misc_feature: GZ8MTXP02GWF4Z.21.78.H01.1.454.CMB.2.raw
  modified_base (318)..(318): a, c, t, g, unknown or other
  modified_base (660)..(660): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttacaaaggtgtccagtgtgaggtgcaggttgggtggagacgtgggaggaggtcttgactccgaggtccggtcgggggtcctggacgtactctcctgtgctgtctcgtgggttcgtcgaggtggacgactacagtgagtcgtgggtccnccgaggcctcggaggggacggcgtaggagtggatcgtactactttatttagtaggtggtacggtaccccaactatactaacacgaacgtactcgggtacgaacggggtcctacttaccacctattccacgaaagaacgaactaaacgttaccgaaagaaacctacgtatttacgtaacttcttaaacaaagttaagtaaacctaaacgtgaacggacgacggaacgacgaccggtactaattagttaacttacgtaggttgggtacgggtactttacgtttacccgttacgggcccccgggtagggggaccccggtaccgtcgtaccccgaccggttccccncccccaaccgtacccgaaccggtaacccgg

SEQ ID NO: 419118 - DNA, 660 bp, Homo sapiens
  misc_feature: GZ8MTXP02ILHNF.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccaggccgtggggggtccctgagactctcctgtgctagtctcgtgggttcgtcgaggtggcgaactacatgagcgtcgggtccgccgaggcctccgaggggaacgggccgtggaggtggacttctcgtacttatttagtaggtggtagtaccccatatactacacagactccggtagaaacggccgtattccaacatcctacaagaaagacaattaccaagaacactattgtaactacttacaaaatgtaaactaaacctggaacgacgccggaaagaccaccgggacctaagttataacgtttacgtggtaggtggggtactacgttttaaccgtcgggaacccccggtcgggggtaaccccggggtaaccctcggggtacccaacccgttcccccgtacccccgtacccccgtacccgaacccgaaaccccgggg

SEQ ID NO: 419119 - DNA, 686 bp, Homo sapiens
  misc_feature: GZ8MTXP02HVY76.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggagcttgatccagcgtgggggtcctgagactctcctgtgcagtctcgtgggtctcagtggcactacatgagcgtcgggtcccgccgaggcctaccggaaggggaacgggccgtgggaggttggacttcgtctactttagtttacgtaggtggtacggtacccacgtactactaacacacgactccgggtagaacggtccgtacttcaccgtatccctagaaagaacgtactaaacgttcccgaaaggaaaccctactagttttacgactttacgtaaacaaaagttcgaaaacttaacccgtagacgaacggcccgaaacggaccaacggtcctaattaggttaaacttcggtaggtacgggtcgggtaacttacgttttccggttaaaccgcccgggggtacgggggaccccggtaaactcgggtaccccgcccgttccctacccccgaccctaccgaacccgtaacccggg

SEQ ID NO: 419120 - DNA, 595 bp, Homo sapiens
  misc_feature: GZ8MTXP02JCHOZ.21.78.H01.1.454.CMB.2.raw
  modified_base (495)..(495): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtccgccaggctccgagggaggcctggagtggatctcactttattatagtggtacgtacccacatactacacagactccggtagaacggggccacgttccacctatctacagaaacgactaattccaagaacactattgtaatcttacaaaattgaaactaacgtgaagagaccgagacacggcctaatcgtattacgngtcggtgggacttacgtttacgtccgtaaccccggcgggggtcccggtaacccgtggtacccgaacccgtccctacccccacccgtcccacgaacccggg

SEQ ID NO: 419121 - DNA, 561 bp, Homo sapiens
  misc_feature: GZ8MTXP02FHULU.21.78.H01.1.454.CMB.2.raw
  modified_base (344)..(344): a, c, t, g, unknown or other
  modified_base (361)..(361): a, c, t, g, unknown or other
  modified_base (380)..(380): a, c, t, g, unknown or other
  modified_base (427)..(427): a, c, t, g, unknown or other
  modified_base (451)..(451): a, c, t, g, unknown or other
  modified_base (473)..(473): a, c, t, g, unknown or other
  modified_base (489)..(489): a, c, t, g, unknown or other
  modified_base (526)..(526): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaagtgcagttggtggagactggaggaggcttgatccagccgtggggggtccctgagactctcctgtgcagtctcgtgggttcgtcagtggcgactacatgagctgggtccgccaggctccgaggggaaggcctggagtggatctcactttatttanagtggtaggtaccccanatactacacgagactccgngaaacgggccattcacatctcagaaagacaattccaagaacacattntatacttacaaaatgaaataaccngagacgcgaggacacggcctangtatactgtgtggggntacttacgttcgacccgtcggggcccggggtaaaccnggtaccaccgtcctccccacccaccaccgaaccgg

SEQ ID NO: 419122 - DNA, 568 bp, Homo sapiens
  misc_feature: GZ8MTXP02FNWME.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgaggggaagggcctgggagtgggatctcactttatttatagtggtggtaccccacatactacacagactccgtgaaggggccgattcaccatctcagaagacaaattccaaggaaacactattagtatacttacaaaatgaaataacctagagagaccgaggacacggcatgtattactgtagtggggctagtttactcgtaccccgtcgggggcccgggaacctcggtcacccgtaccgccccctaccctcccaccgaaccgg

SEQ ID NO: 419123 - DNA, 878 bp, Homo sapiens
  misc_feature: GZ8MTXP02FOYYD.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagtcgttgggttttcctttgttgtcttatttacaaaaggtgtccagtgtgaggtgctaggttggtggagacgtgggaggaggtcttgactccgacggtcccggttcgggggtccctggacgtaccttccgttccgtggtcgcgtacgttccgttcggttgggttccgtcgaggtcggacgaactacgtatggacgtcggtcggggtcccgccgacggtcctaccgggaaggggtaacggggtccgtaggggagtggtactcgtacgtacttttagtttaagtaggtgggttacggtaacccctactaacgtaacctacgacgtaacgtaccgttccggggtaagaaaccgggggtacctaaactttcccgaaccttaactctaaaccgaaaggtaaaccgtaactaaacgttacccgaaacgggtaaaccaccgttaagtttaacgttaacttacttaaacgaaaagtttacgaaaacgtttaacccgagtaacgaacgggtacccgaacggaaccggaccggtaaccgtaagttacgttaactttaaaccgggtggttaaacgggtcggggttaaaccttaacggtttttaccccggtaacccggggttacccccgggggttaaccgggggtacccccgggggttaaaacccgtccggggttacccccgtaaaccccgtttcccccggacccccccttaccgtaaacccccgtacccggtaaacccccgggg

SEQ ID NO: 419124 - DNA, 660 bp, Homo sapiens
  misc_feature: GZ8MTXP02ITGQA.21.78.H01.1.454.CMB.2.raw
  modified_base (306)..(306): a, c, t, g, unknown or other
  modified_base (349)..(349): a, c, t, g, unknown or other
  modified_base (625)..(625): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtggggggtccctgagactctcctgtgcagtctcgtgggttcgtcaggtggcgactacatggagctgggtccgccgnggctccgagggacgggccgtggagtggactctacgtaactttnttaagtaggtcggtacggtaccccacgtataactacacagacctcggtacggaacggtaccgtatacacatctacagaaagtaacaactccaaagaacacacgttatactacttacaaaatagtaaacgtaacctagacgacgggaccgacggtaacgaccggtaccagttacgttaattaacgtggttaggggtacgggtactacgtttaccgtaccggtaccccgggtacgggggaccccggggtaacccgtcggtacccgtacccgtaccccncccccgtaccccgtacccgaacccggaaccccggg

SEQ ID NO: 419125 - DNA, 708 bp, Homo sapiens
  misc_feature: GZ8MTXP02HVEN9.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtggagacgtggaggaggtcttgatccgaggccgtcgggggtccctgacgactctcctgtgcagtctcgttgggttcgtcaggtggcgactacatgagcgtgggtcccgccgaggcctccggagggaacggccgtaggagtggatctctaactttattagtaggtcggtacggtacccacgtactactacacgacgtaccgtcgtaggaaacggggtcctattaccaacctatccctaccgaaagaaacgaactaacgttacccgaaacggtaaacaactatttacgtaaacttcttaacctaaaatacgtaaaactttaaccgagaaacgacggaccggaacgaacgaccggactaagttagtaacgttaacgtggtaggtacggggtacttaacgtttaccgttaccggtaccccgggtacgggggaaccccgggtaacccgttcggtaccccgacccgtttaccccgaccccccaccccggtaaccccaaccccggaaaccccggg

SEQ ID NO: 419126 - DNA, 740 bp, Homo sapiens
  misc_feature: GZ8MTXP02GLWU6.21.78.H01.1.454.CMB.2.raw
  modified_base (276)..(276): a, c, t, g, unknown or other
  modified_base (471)..(471): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgacgccgtcgggggtccctgagactctcctgtgcagtctcgtgggttcgtntaggtggcactacatggagtcgtcgggtcccgccaggcctcgaaggggaacgggcctgggaggtggatcgtactactttatttagtggtgggttacggtaccccacgtatactacaacgacgtaccgtccggtaggaacgggccgtattaccaccgtatccgtacaagaaacgaacaacttaccgaagaaaaccnctagttagtacttacttaacaaaatagaaaacttaaccgtgaaggaacgacccggaaaggacccacgggtacctagttagttaacgtttaacggtggtttacgggtacgggggtaccttaaacgttttacccggttaccgggtaacccccgggggttcggggggtaacccccgggggtaaccccggttcggggttaccccctaaccccggggttaccccctaacccccccgtacccccgtacccgtaaaccccgggtaaaccccggggg

SEQ ID NO: 419127 - DNA, 724 bp, Homo sapiens
  misc_feature: GZ8MTXP02HUKT5.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggtttccttgttgctatttcaaaaggtgtccagtgtgaggtgcagttggtggagactgggaggaggcttgatccagccgtgggggtccctgagactctcctgtgcagtctcgtgggttcgcagtggcgactacatgagcgtcgggtccgccgagggcctccgaggggaacgggcctgggagtgggactcgttcacttttattataggtggtcggtaaccccatactaactaccaactacgactccggtagaacgggcctacttccaccatccagaacgaaagacaaaattcccgaaaggtaaaccactaaagttttacgtacttacttaacgtaaataacgtaaactaaccgtaggaacgaccggaaccgaacggaaccgtaccggaactaacgttacgttaacgtttacgtagggttacgggtacgggttacttaaacgttttaaccggttacccgggtacccccgggggtaccgggggtaccccgggtaaacccggttccgggttaccccgtaacccccggttccccccgtaaccccccgtaacccccgtaccccgaaaaccccggtacccgg

SEQ ID NO: 419128 - DNA, 663 bp, Homo sapiens
  misc_feature: GZ8MTXP02H9G4X.21.78.H01.1.454.CMB.2.raw
  modified_base (500)..(500): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtgagacgtggaggagctgatccagccgtgggggtcctgagtactctcctgtgcagtctcgttgggttcgtcgaggtcggcgtactacagtgagcgtcggggtccgccgaggccgtccggaggggaacggccgtagggagtggactcgtctaactttattagttaggtggtacgtacccactactactacacacgacctcgtaggaaacggccgtattaccacctactctaccaagaaacgaactaacgttacgaacgaacactattacgtattactaacaaaattgaaaactacgtaganacgacgacgaccacggcatagtatacgtggtcgtagggtcttaacgtttacgttaccggaccccggtacgggggtaccccggggtaacccgttcggtaccccgtaccccggtaccccgtaccccccctacccccgtaccccggtaaacccgtaacccccgggg

SEQ ID NO: 419129 - DNA, 684 bp, Homo sapiens
  misc_feature: GZ8MTXP02FO77M.21.78.H01.1.454.CMB.2.raw
  modified_base (254)..(254): a, c, t, g, unknown or other
  modified_base (300)..(300): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctctgtgcngtctcgtgggttcgtcaggtcggcgactacatgagcgtcgggtccnccgaggcctccggaggggaacgggcctggagtggactctctactttatttagtaggttgggtacgtaaccccagtactactacacgacgtacctccgggtagaaacggggtccgtacttaccgaacctatacctacgaaaggaaacgtaaacctaaacttacccgaaaggtaaacccactaatttagtaacttacttaacaaaatcgaaaactaaccgtagaacgacggaccgaggaccacggactatgtattacgtggtcggtcgggacttacgtttaccgtccggtaccccggggttacgggggacccccggttaaccgtcgggttaccccgaccccgttcccgtacccccccgtacccgtaccccgaacccggtaacccgg

SEQ ID NO: 419130 - DNA, 861 bp, Homo sapiens
  misc_feature: GZ8MTXP02JW8SE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaagtgcagttggtggagactgggaggaggcttgatccagccgtggggggtccctgagactctcctgtgcagtctcgtgggttcgtcaggtggcgactacatgagcgtcggggtccgccgagggcctaccggaagggggaacggggcccgtaggggtaggtcgggtaacttctactaacttttaagtttagttaggtgggttacggtaaccccactaactactaacacaacggtacctcccggttagggaaacggggtcccgtaatttaccccgaaacctacttcccgtaaccgaaacggaaaacgtaaaccgtaaaccttaccccgaaaaggggtaaaaccctaacgttaaacgttttacgttaaactttaccgtttaaaacaaaaacgttaacgtaaaacgttaaaaccccgttagggaaaccgggtaacgggaaccccggaaaagggaaaccccgaaccggggtaccccgtaaagtttacggttaaaacttttaccgggttagggttagggggttcgggggtaaccttttaaaccggttttaccgtttacccggggtaccccccggggtacggggggtaacccccggggtaaacccggttccgggtaccccgtaacccccggttcccctacccccccgaccccgttaacccccgaaccggaaacccccgggg

SEQ ID NO: 419131 - DNA, 623 bp, Homo sapiens
  misc_feature: GZ8MTXP02FO198.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtccgcaggctccgagggaaggcctggagtggatctactactttatttagtaggtggtaggtaccccactatactacacaagacctccgagaacgggccgaattccaccatctacaagaaacgaactaattacccgaaaggaaaccactaattagtaattacttacaaaatgaaaactaaccgtagaagacgaccgaaggaccacggactaagtgttaattacgtgtggtcggggacttactttaacgttcgaccccggttcgggggaccccgggtaacccgtggtcccacccggttcccacccccgaccctcccgaaccgtaacccggg

SEQ ID NO: 419132 - DNA, 567 bp, Homo sapiens
  misc_feature: GZ8MTXP02F1SV9.21.78.H01.1.454.CMB.2.raw
  modified_base (300)..(300): a, c, t, g, unknown or other
  modified_base (343)..(343): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccaggctccgagggaggcctggagtggatctcactttatttanagtggtggtaccccacatacacacagctccggtgaacggggccattcacatctcagagacaattcaagaacacattgtatctacaaatgaaataacctgagagacgaggacacggccatgtaattacgtggtgtggggtctacgtttacgttcgtacccggtcgggggacccggggtaaccgtcggtccaccggtccctcccccgtaccctcccaccgaaccgg

SEQ ID NO: 419133 - DNA, 616 bp, Homo sapiens
  misc_feature: GZ8MTXP02I16A7.21.78.H01.1.454.CMB.2.raw
  modified_base (371)..(371): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccgaggcctccgagggaacggggccgtgggacgtggactctctactttaattatagtggtagtaccccgtanatactacacacgactcgtagaacgggccgatcaccatctcagaacgacaattacaagaacacattgatactacaaatagaaatacctagagacgccgaaggacacgccaagtgtactacgtggtacgtggggtactacgtttacgtacggtaccccggttacgggggaccccggggtaaccgtccgggttaccgtacccggttacccgtccccccgtaccccgttacccgacccggaaacccggg

SEQ ID NO: 419134 - DNA, 659 bp, Homo sapiens
  misc_feature: GZ8MTXP02HHXAJ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtcctgagactctcctgtgcagtctcgtggttcgtcgagtggcgactacagtgacgcgtcgggtccgccgaggcctccggaggggacggccgtaggagtggatctactactttattagtagtggtagtacccacatactacacacgactcgtagaacgggcctatccacactcacagaaagtacaacttacgaagaacacgtattagtacttctaataaataagtaaactaaccgtagacgacggaccggaacggaccgaacggacctaagtcgttaattacgtggtacgggtcgggtacttaacgtttaccgttaccggtaccccgggtacgggggtacccccgggtaacccgtccgggttacccgacccggttcccccgtacccccgtacccccgtacccggaacccgtaaccccgggg

SEQ ID NO: 419135 - DNA, 933 bp, Homo sapiens
  misc_feature: GZ8MTXP02HP5L9.21.78.H01.1.454.CMB.2.raw
  modified_base (259)..(259): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtgggaggaggcttgatccaggccgtgggggtcctgagactctcctgtgcngtctcgtgggttcgcgagtggcgactacagtgacgcgttacggggtcccgccgaggccgtaccggaaggggaaacggggtcccgtggggaaggtgggaactttccgtcgttaactttaagtttaagttaggtcggggttacggtaacccccaacgttaataaccgtaaacacgaacggtaaccttcccggggtaaggaaacggggtacccgtatttacccaaccgtaacttcctaaccgaaagaaacggtaaaccctaaacgttacccccggaaaagggtaaaaccctaaccgttaaatttacggttaaactttaccccgtttaaagtaaaaactttaaaccgggtaaaaaactttaaacccggttaagggaaaacggttaaccggggaaaccccgggaaacggggtaaaccccggaacccggggtacccctaaaagtttacggtttaaaacggtttaccgttaggggtttacgggggttacgggggttaaacctttaaacggtttttaacccgggtttaacccgggaacccccccggggtttacgggggggtaaccccccgggggttaaaccccgttcccggggttaacccccggtaaccccgggttacccccctaaccccccccggtttaacccccaacccccggtaaacccccggttaaaacccccggggg

SEQ ID NO: 419136 - DNA, 701 bp, Homo sapiens
  misc_feature: GZ8MTXP02HOYSK.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggtcttgatccgaggccgtgggggtccctgagactctcctgtgcagtctcgtgggttcgtcgagtggcgactacatgagctgggtccgccgaggcctcgagggaacggccgtggagtggatcgtactagtttacttaagtaggtggtcggtaccccactaatacctaacactaacggtactccggtacgaagggacccgtacttaccaacccgtacttacctacgaagtaaacgaactaaacgttacccgaaggaaactactagtttactaagttactactaaaagtagtaaactaaaccgttgaagtacgaccgaacggaacgtacgccctaagtacgttaaccgttaagtgggtacggttacggggtaccttaacgtttttaccgtaccggtaaccccgggtcgggggtaaccccggggtaaccgtccgggtacccgtaccgtacccccgtaccccgtcccgtaacccgaaccggtaaaccccgg

SEQ ID NO: 419137 - DNA, 856 bp, Homo sapiens
  misc_feature: GZ8MTXP02G079J.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcgagttggtggagactggaggaggcttgatccagccgtcgggggtcctgagactctctgtgcagtctcgtgggtcgtcgagtgcgactacatgagcgtgggtccgccgacggcctccggaggggaacggccgtggaggtggattcgtactaactttatttaagtaggtgggttacggtaacccctaacgtacttaaccgttaaccacgtaacggtacccgttccgggtacgggtaaacgggggaccctaacgttcccgaaacctacttaccgtacgaaacgtaaaacggtaaccctaaacgtttacccggaaacggtaaaacctaaacccgtagtttttaacgtaaactttacccttaaaataaaaacgtttacggtaaaaaacctttaaaccccggttagggaaacccgaacgggggtaaacccccgggaaaggggtaaaaccccgacccgggggaacctaaacgttttagggttaaaccgttttaaaccgttggggttagggggtacgggggttaactttaacggtttttaaacccggtcccggggtaacccccggggttcggggggggaaccccccgggttaacccgttcgggtaccccttaaccccgggttcccctaccccccggtaccccgtaaccccgtaaacccgggaacccccggg

SEQ ID NO: 419138 - DNA, 761 bp, Homo sapiens
  misc_feature: GZ8MTXP02FOEZ1.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctgggtgtccctgagactctcctgtgcagtctcgtgggttctcagtggcgactacatgagcgtgggtcccgccaggctccgaggggaacgggcctggagtggatctactactttattagtaggtcggtacgtacccatatacctacaccgagcccgttccggtaggaaacgggggccctaagtttccaaaccctagttcctacgaaagaaacgtaaacctaaacttacccgaaacgggaaacctaacgtaaacgtttagttaaacttacctttaaacctaaaagttacggtaaaaccttaaacccgttagggaaacgggaaccggacccgggaaacgggtaacccgaaccggggtaaccctaagttacggtttaaacgtttaaccgttaggggttcgggttacgggggtacctttaaacgttttaccggttacccgggtaaccccgggtcggggggtaccccgggggtaaacccgttcgggtacccgtaccccgttacccgtaccccccgtacccgtaccccgtaaaccccggg

SEQ ID NO: 419139 - DNA, 654 bp, Homo sapiens
  misc_feature: GZ8MTXP02FKOPQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtcgggtccgccaggctccgaggggaacggctggagtggatctctactttatttataggtggtacggtaccccaactataactaacacagtactccggtaggaaacgggccgtattccaacctatctaccaagaacgaacaattcccgaaaggaacccaatattagtaattactactaaatagaaactaaacctgaagacggacgaaggaccaacggccaatgtaattacgtgtacggtgggggtacttaacgtttaccgttacggtacccccgggtaccgggggaccccgggggtaaaccccgtcggtaccgtaccccggtaccctccccccgtaccccgaccccgacccgaaaccccgggg

SEQ ID NO: 419140 - DNA, 739 bp, Homo sapiens
  misc_feature: GZ8MTXP02I0RG2.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtggaggtgcgagttggtggagacgtgggaggaggcttgatccagccgtcgggggtcctgacgactctcctgtgcagtctcgtgggttcgtcgagtggcgtactacgatggacggcgtcggggtcccgccgacggcctaccggaaggggaacgggccgtagggaggtgggacttccgttctaacgttttaatttagtaggttaggtccggtaaccccaactaatactaaccaacgaacgtaccgttcccgggtaagggaaacggggccgtaacttccgaaccctacttacctacgaaacgaaacggaaactaaacttaccgaaacggaaaccactaatttacgtaacttacttactaaaattacgtaaaactaaccgttagaagtaacgggaccggaacgaaccgaccggaccgtaagtacgttaaacgttacgtgggttagggtaggggtacttacgtttaacggttaccggtacccggtacgggggtacccgggtaacccggttcggtaccctacccggtcccacccccgtacccacccgtaccgaaccccgg

SEQ ID NO: 419141 - DNA, 652 bp, Homo sapiens
  misc_feature: GZ8MTXP02GUO4E.21.78.H01.1.454.CMB.2.raw
  modified_base (298)..(298): a, c, t, g, unknown or other
  modified_base (361)..(361): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagcgtgggtccnccgaggctccgaggggaaggcctggagtggatctctactttattatagtggtaggtaccccanatactacacagactccgtagaaggggtccattcacctatcctacgagaaagactaaattccgaaaggtaaacactattagtatacttacaaaatgtaaaactaccgtagacgacggaccgaaggaccacgggaccaagtagttattacgtggttacgggtcggggacttacgttttacggtacggtacccccgggttacggggggaccccggttaaaccccgtcgggggttacccaaccccgggttccctacccccccgtaacccgtaccccgaaccccgtaaacccgggg

SEQ ID NO: 419142 - DNA, 607 bp, Homo sapiens
  misc_feature: GZ8MTXP02GVJUL.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagcgtggggtccgccgaggcctccgaggggaacgggcctggagtggatctcactttattatagtggtggtaccccacatactacacagactccgtagaacgggccagttccactatctacagtaaacgacaattccaaggaaacacattagtacttctacaaaatgtaaataacctgaagacgaccgaaggactacggaccatcgtatacgtggtacggtggggctatttaccgtcgtaccccggtcgggggaacccggggtacccgtcgggtcctaacccggtcccttacccccgaccctacccgaacccgtaacccgggg

SEQ ID NO: 419143 - DNA, 751 bp, Homo sapiens
  misc_feature: GZ8MTXP02GH5OR.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggaggaggcttgatccagccgtgggggtccctgagactctcctgtgcagtctcgtgggttcgtcaggtggcgactacatgagcgtcgggtcccgccgaggcctccgaggggaacgggccgtggaggtggatcgtctactttatttataggtggtacggtacccacataactacacgagactccgtagaacgggccgtattccaacctatctacaagaaacgaacaaacttacccaaggaaacactaacttagtaataccttacaaaattacgaaaacttaaaccctagaaacgaacgggacccggaaaacgggaccgaaacccggggtaccctaaattacggtttaaacgtttaaccgttggtttacggggtacggggggttaccttaaacggtttttaaacccggtttacccgggaccccccggggtttaccgggggggacccccgggggttaaaacccccggtccgggttacccggtaacccccggttccccctacccccccgtacccccgtacccccgaaacccggtaaaacccccgggg

SEQ ID NO: 419144 - DNA, 788 bp, Homo sapiens
  misc_feature: GZ8MTXP02IY26O.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccagccgtgggggtcctgacgactctcctgtgcagtctcgttgggttcgtcaggtggcgactacatgagcgtcgggtccgccgacggcctaccggaggggaacggggccgtaggggaggtggacttcctactaacttttaagtttagttagggttcgggttacggttaaccccctacgtaacttaaccttaaccaacgaacgtaaccgttcccgggtagggaaacggggtacccgtaacgttaccgaaccctacttacccgtaacgaaaggtaaacggtaaacctaaacgtttacccgaaacggtaaacctaacctaagtttacgttaacttaccttaactaaaattacgtaaaacttaaaccgtagaacgacggacccggaaaggaacccgacgggacctaagttacgttaaacgttacgtaggttcgggtacggggtacttaacgtttaccggttccggtacccccggggtcgggggtaacccccggggtaacccgttccggtaccccgtaaccccgggttccccttaccccccgaccccgtaccccgaacccgtaaaccccgggg

SEQ ID NO: 419145 - DNA, 641 bp, Homo sapiens
  misc_feature: GZ8MTXP02G2DUQ.21.78.H01.1.454.CMB.2.raw
  modified_base (381)..(381): a, c, t, g, unknown or other
  modified_base (416)..(416): a, c, t, g, unknown or other
  modified_base (449)..(449): a, c, t, g, unknown or other
  modified_base (592)..(592): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgctatttcaaaaggtgtccagtgtgaggtgctaggttggtggagacgtgggaggaggtcttgactccacggccggtcgggggtcctgagtctctctgtcgctacgttctcggttgggttcgtcgaggtggcgactacgagtgagtcgtcgggtccgcgacggcctacggagggacggcgtggagtggactcgtctactttatagtggtgtcgaccctanactacacacacgtactcgagacggcctagtccacnctcacgagaaacactactacgagaaactacgtnttagtactacgtaataaatgtaaaactacgaggacgacgacggaacggaacaccgggtaactagttacgttaacgtacggtggtgggtacgggtactttacgttttaacgcccggtcccgggtacgggggaccccggttaacncgggtaccctacccggtccctaccccgacccgtaccgaacggtaccccg

SEQ ID NO: 419146 - DNA, 700 bp, Homo sapiens
  misc_feature: GZ8MTXP02INA89.21.78.H01.1.454.CMB.2.raw
  modified_base (458)..(458): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagctctcctgtgcagtctcgtgggttcgtcgagtggcgactacatgagctgggtcccgccaggctccgaggggaacggcctggagtggatctctactttatttatagtggtagtaccccacatactacacaagacctccggtgaacggggccgtattccaaccgtatctacagaacgaacaacttccgaaggaaacacgtatttacgtaataccttanaaaatagtaaactaaacccgtagtacgacggacccgaacgggaccgaaccggggcctaagttacgttaacgtttaacgtcgggttagggttcgggggacctttaacgtttttaacccggttacgggttaccccccgggttacggggggtaccccgggggtaaacccccggttcgggtaccccgtaaccccggtacccctaccccccgtacccccgtaccccgtaaccccgtaaaccccgggg

SEQ ID NO: 419147 - DNA, 646 bp, Homo sapiens
  misc_feature: GZ8MTXP02GULLM.21.78.H01.1.454.CMB.2.raw
  modified_base (407)..(407): a, c, t, g, unknown or other
  modified_base (453)..(453): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtccgccgaggcctccggagggacggcctggagtggatctctactttatttagtaggtggtcgtaccccagatactacacacgacgtccggtagaacgggcctagtccacntcacagaacacaactcgaagaacactattgtactctaacaaagtanaaactacgtagacgtacggccgaaggacctacgcaattggtaattcgtggttacggtacggggtacttacgtttaccggtaccggtaccccgggtaccgggggtaccccgggtaaacccggtccggttaccccgtaaccccgttcccccgtacccccgtaccccgttaccccgaaccccgggtaaaccccggg

SEQ ID NO: 419148 - DNA, 648 bp, Homo sapiens
  misc_feature: GZ8MTXP02JVJY2.21.78.H01.1.454.CMB.2.raw
  modified_base (443)..(443): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcagtggcgactacatgagctgggtccgcaggctccgaggggaggcctggagtggatctcacttattatagtggtggtaccccacatactacacagactccgaggaagggccgattccaccaatcctacagtaaagaacctaattcccaaggaaccacatttacgtatccttaanaaagtgaaactaaccctaggaagtaacgggaccgaaggaaccctacgggaccctagttacgtaactttaacgtggttaggtagtcgggtactacgtttttaaccgtcgaccccccgggtagggggggaacccccgggtaacccgttcgggggttaccccaacccggttcccgtaccccccctacccgttaccccaaaaccccggg

SEQ ID NO: 419149 - DNA, 636 bp, Homo sapiens
  misc_feature: GZ8MTXP02I65GC.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtggggtcccgccgaggcctccgaggggaacgggcctggagtggatctctactttatttatagtggtcggtaccccacatactacacacgactccggtgaacgggccgtattccaccgtatcctcaagaaacgaacaacttaccaaggaaacacctaatttagtaattacttacaaaattagtaaactaaaccgtaggacgacggaccggaaggaaccgacggccattgtattacgtgtggtggggactacgtttacgttcggaccccgttcgggggacccggggtaacccgtgggtccccaaccggttccctacccccgtacccctacccgaacccgaacccggg

SEQ ID NO: 419150 - DNA, 626 bp, Homo sapiens
  misc_feature: GZ8MTXP02HV316.21.78.H01.1.454.CMB.2.raw
  modified_base (259)..(259): a, c, t, g, unknown or other
  modified_base (379)..(379): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggcttgatccagccgtggggggtccctgagactctcctgtgcngtactcgttgggttcgtcgaggtggcgactacatgagcgtcgggtccgccgaggcctaccggaaggggaacgggccgtagggaggtgggatctctactttattatagtggtcgtacccanatactacacagactccgtagaacggccgattccactatcacaagaaagactaactacaagaaaccatattagacttcttaaaacaaagtacaaactaacgtagaacgacgacggagaccgtacgactagtagtatcgtggtcggtacggtacttacgtttaccggtccggtacccgggtcggggtaacccggtaccgtccggtacccgtacccgtcccctacccccgacccgtaccgaaccggaccg

SEQ ID NO: 419151 - DNA, 714 bp, Homo sapiens
  misc_feature: GZ8MTXP02JVIPP.21.78.H01.1.454.CMB.2.raw
  modified_base (435)..(435): a, c, t, g, unknown or other
  modified_base (502)..(502): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagccgtgggggtccctggagactctcctgtgctagtctcgtggttcgtcaggtggcgactacatgagcgtgggtccgccgacggctccgaggggaacggccgtggacgtggactcgtcgtatttatttagtaggtggtcggtaccccactatactaacacaacgtacctccgggtagaaacggggtcctaacgttcaccgacttcccganaaaaggaaacgtaccaaactttccccggaaaagtaaccactagttttacgtaattcccgtttaaaanaaaacgttgtaaaactaaccggtagaacgacgggaccggaaacgtacgaacggtctagttagttacgttacggtggttacgggtcggtaaccttacgtttacccggtacccgggacccccggggtacgggggtaaccccggttacctccgggttcccctaaccccggttccccctacccccggtaacccctacccggaacccggtacccggg

SEQ ID NO: 419152 - DNA, 655 bp, Homo sapiens
  misc_feature: GZ8MTXP02IWKSK.21.78.H01.1.454.CMB.2.raw
  modified_base (312)..(312): a, c, t, g, unknown or other
  modified_base (389)..(389): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtgggaggaggcttgatccgaggccggtcgggggtcctgacgactctctgtgctagtctcgtgggttcgtcgaggtcgcgactacagtgagccgtcgggtccnccgaggctaccggaggggacggctaggagtgactctctactttattagtaggtggtacgtacccactaatactacanacgactcggtaggaacggggcctaactcgacctatcctaacgaagaaacgactaactcgaaagaacactattacgtaattactaagaaaatagaaactacgtagaacgagaccggaagaccgtacggctaacgttgtacttagtggttggtacggggtacttaacgtttaacggtcccggtaccggggtacgggggaccccggtaaaccgtcgggtccctaacccgtccccgtaccccctacccgtacccgaacccggtaacccgg

SEQ ID NO: 419153 - DNA, 690 bp, Homo sapiens
  misc_feature: GZ8MTXP02JNTT7.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttctcgaggtggcgacttacatgagcgtcggggtccgccgagggcctccggaaggggaacggggccgtaggggagtgggacttccttcctaacttttatttaatacggttgggtaggttaacccccacaattacctaacacacgactccggtaggaaacggggccctaattccaaccatcctacagaaacgactaacttccaacggaaacacgtaattcgtaattccttataaaatcgtaaaacttaaccgtaggacgaacggacccgaaaggaccaacggggacccattacggtattacgttggtagggtcggggtctaacgttttacctacgggtcccccgtacggggggtccccggtaacccggttcggtacccgtacccggttccctacccccaacccgtccccgaacgtaaccccgggg

SEQ ID NO: 419154 - DNA, 690 bp, Homo sapiens
  misc_feature: GZ8MTXP02FQ5KA.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgacgcgtcgggtccgccgagggcctaccgggaaggggaacggggtcccgtagggaggttgggacttccgtactaacgttttatttaagtaggttggtacggtaaccccactagtaactacacagtacctcggtagaacggggtcctattccgaactagtacctacgaaacgaaacggtaacctaaacgttacccggaaaggtaaaccacgtaatttagtacttactaacaaaattacgaaaactaccgtagaacgacggaccgaaggacacggactagtcgtaattacgtggtggtcgggacttacgtttacgtccgtaccccggggtgggggaccccgggttaacctggggtaccctacccggtacccctacccccaacccgtcccaaaccggtaacccgg

SEQ ID NO: 419155 - DNA, 636 bp, Homo sapiens
  misc_feature: GZ8MTXP02I97LJ.21.78.H01.1.454.CMB.2.raw
  modified_base (379)..(379): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgactacatgagcgtgggtccgccaggcctccgagggaggcctggagtggatctcactttattagtagtggtgtaccccacatactacacagactccggngaacgggggcctagttccacatcctacaagaaacgaacaattccaaggaacacgtattagtactcttacaaaatagaaactaacctgagacgaccgagaccacggccatgtatactgtacggtgggtactacgtttacgttaccggtaccccggtacggggggtaccccgggggtaaacccgttcggggttaccccgtaccccggtaccccgttaccccccgaaccccgttccccgaaacccggtaaacccccgggg

SEQ ID NO: 419156 - DNA, 749 bp, Homo sapiens
  misc_feature: GZ8MTXP02HRSTZ.21.78.H01.1.454.CMB.2.raw
  modified_base (286)..(286): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagactgggaggaggcttgatccagccgtgggggtcctggagactctcctgtgcagtctcgtgggttctcagtggcgactacntgagcgtgggtccgccgaggcctccgaggggaaggccgtggagtggatcgtacactttaattagtaggtggtacggtaccccacaatactacacagactccggtagaagggccgtattacaccatctacaagaaagaactaaacttcccgaaaggtaaccaacgtattaggtaacttccgttaactaaaatcggaaaacttaacccgttaggaagaaacggtacccggaacgggaaacccacggggtaccaacggtttacgtaacgttttaaacggtcgggttaggggttacgggggtacctttaaacgtttttaacggttacccggtacccccggggtttaacgggggggaccccccgggggtaaaacccgtttccgggggtaccccaaccccggggtttaccccctacccccccgtaaaacccccggtttccccgaaaacccccgggttaaaacccggggg

SEQ ID NO: 419157 - DNA, 617 bp, Homo sapiens
  misc_feature: GZ8MTXP02F3DUD.21.78.H01.1.454.CMB.2.raw
  modified_base (498)..(498): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctctgggttcgtcaggtggcgactacatgagcgtgggtccgccaggctccgagggaaggcctggagtggatcgtcactttattataggtggtaggtacccacatactacacagactccgtagaacgggccattcacatctacagaaacacaattcccaaggaacactattgtactcttacaaatagaaactaaccgtgaagtagaccgaaggaccacgggcctaatcgtaatttaacgnggttaggtcggggtactacgttttaacgttcggaacccccggttcgggggaccccgggtaaacccgtcggtacccgacccgttccctacccccgacccgtcccgaacccgtaacccggg

SEQ ID NO: 419158 - DNA, 678 bp, Homo sapiens
  misc_feature: GZ8MTXP02JHV4J.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtgggttacgtcgaggtcggacgactaacgagtgacgtcgtcggggtcccgaccgacggccgtaccggaacggggaacggccgtaggagtagggactcgtacttacttatttagtggtggtacggtaaccccgactactacaactacgacgtactccggacggacggccgtattacccacataccacgaagaaacgtactaaagtcccaaaggaaccagtaacttagtactacctaataaaagtataaactacgtagagacgacggaacggaccacggaccgtaatcgttatacgtggtaggtagggacttacgtttaccgtaccggacccgggtacgggggtacccgggaacccgttcgggtacccgtaccccgtccccgtaccccgtaccccgtaacccgaacccggaaccccggg

SEQ ID NO: 419159 - DNA, 660 bp, Homo sapiens
  misc_feature: GZ8MTXP02I0G64.21.78.H01.1.454.CMB.2.raw
  modified_base (298)..(298): a, c, t, g, unknown or other
  modified_base (367)..(367): a, c, t, g, unknown or other
  modified_base (441)..(441): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtggaggaggcttgatccagccgtgggggtccctgagctctctgtgcagtctcgtgggttctcagtggcgactacatgagcgtgggtcccnccgaggcctaccgaggggacggccgtggagtggacttctctactttatttagtagtggtcgtaccccanactactacacacgactcggtagaacgggcctacttccactagtcacgagaaacgacaaacgttcccaagaaacncgttaattcgtaactacttaacaaaagttacgaaaacttaacccgtgaaacggacggtacccgaaggaccaccggactaaagttgttaaatcgtggtacggtcgggtaccttagtttaccgtccggtaccccgggttcgggggaacccggtaacccgttcgggtacccctaccgggttacccccacccccgtacccgtacccgaacccggtaacccggg

SEQ ID NO: 419160 - DNA, 654 bp, Homo sapiens
  misc_feature: GZ8MTXP02HO8EZ.21.78.H01.1.454.CMB.2.raw
  modified_base (255)..(255): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctcctgtgcngtctcgtgggttcgtcgagtggcgactacatgagcgtgggtccgccaggctccgaggggacggccgtggagtggatctctactttattataggtggtggtaccccacgtatactacacacgctccggtagaacggcgacttaccacctatcctacagaaagactaacttccgaagaacacgtattagtactacttacaaaatgtaaacttaaaccgtgaaggacggccgaaacggacgaaccggcctaagtggttaattaacgtggtacggtcgggggtacttaacgtttacgttccggtaacccccgggtcggggggtaccccggggaaccccgttcgggtaccccgtaccccgttcccttaccccccgaccccgtacccgtaacccggaaccccggg

SEQ ID NO: 419161 - DNA, 813 bp, Homo sapiens
  misc_feature: GZ8MTXP02F70IG.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgagtcggcgactacagtgagcgtcgggtccgccgaggcctccgaaggggaacgggccgtagggagtggactccgtactaacttttactttaagtaggttgggtacggtaacccccgtactaacgtaactaaccgacaacgtacctttccgttagggaaacggggtacccgtacttacccaaccgtactcccgtaacgaaaggtaaacgtaaccgtaaaactttacccgaaacgggtaaaacctaaccgttaagtttaccggttaacttaccctttaaactaaaaaacgttacggtaaaaaactttaaacccccggttagaaaccgggtaacgggtaaccccggaaacgggaaacccgacccgggtaacccttaagttacggtttaaacgtttaaccgtgggttacgggttacgggggttaccttaaacggttttacgtacccggtacccccgggtacgggggaccccgggttaaacccgtcggttacccgacccggttaccccctacccccgtacccgtaccccgaaccggtaaccccgg

SEQ ID NO: 419162 - DNA, 812 bp, Homo sapiens
  misc_feature: GZ8MTXP02IOCLH.21.78.H01.1.454.CMB.2.raw
  modified_base (257)..(258): a, c, t, g, unknown or other
  modified_base (272)..(272): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcaggttggtggagacgtgggaggaggcttgatccagccgtgggggtccctgagactctcctgtgnngtctcgtgggttcncaggtggcgaactacatggacgcgtcgggtccccgcccgagggcctaccggaaggggaacggcccgtaggggagtggactcttactaactttatttagtaggtggtacggtaaccccactactaacctaacactagacctcgggtagggaaacgggtcccgtaattcccgaactacgttcctaccgaaagaaacgtaaactaaacttacccgaaaagtaaacctaacgttaatttagttaacttacttacctaaaaagttacggtaaaactttaaaccgtacgggaaaggtacgggaaaccccgggaacgggaaccgaaccgggtacccgtaaagttacggtttaacgtttaaaccggttgggtttacgggtacgggggttactttaaacggtttttaacccggttaccggggtaacccccgggttcgggggggtaacccccggttaaaccccggttcgggttaacccccgttaacccccggttccccttaacccccccgtaccccggttaacccccgaacccgggtaaaacccccgggg

SEQ ID NO: 419163 - DNA, 758 bp, Homo sapiens
  misc_feature: GZ8MTXP02JFL8V.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagtttggctgagctgggttttccttgttgctatttcaaaaggtgtccagtgtgaggtgctagttggtggagacgtggaggaggtcttgactccgaggccgtgggggtccctgagtactctcctgtgcagtctcgttgggttcgtcgaggtcggcgtactacagtgacgcgtcgggtccaccgaggcctccggaaggggacggccgtggacgtggactctctaactttatttagtagtaggtcgaccctactataccaactacgaacgtaccgtccgggtagaaaccggggcgtaacttccaaccgtatctaacgaagaaacgaactaaacttaccgaaacggtaaactaacctaagtttaacgttaacttacctttaaactaaaacgttaacgtaaaaacgttaaacccgtaaggaaggtaaccggaacccgggaaacgggaaccgaccgggtaaccctaagttaacgttacgttaacggtcggttaggggttacgggggactttaaccggttttacgttaccggtacccccgggtacgggggtacccccggtaacccgtccgggtaccccgtaccccgtaccctaccccccgtaaccccgtaccccgaaccgtaaacccccggg

SEQ ID NO: 419164 - DNA, 609 bp, Homo sapiens
  misc_feature: GZ8MTXP02J4MOA.21.78.H01.1.454.CMB.2.raw
  modified_base (406)..(406): a, c, t, g, unknown or other
  modified_base (436)..(436): a, c, t, g, unknown or other
  modified_base (500)..(500): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtgagactggaggaggcttgatccgagccgtggggggtccctgagactctcctgtgcagtctcttgggttctcagtggcgatacatgagctgggtccgccaggcctaccgagggaagggcctggagtggatctctactttatttatagtggtggtaccccacatactacacagactccgtgaacggggccgattcacctattacncaaggaaacacaaattcccaaggaaccaanatttgtaattactttacaaatactaaactaactacgagacggcgacgggacacggtccaagttnttattagtggtgtcgggtctacgttacgttaccggacccggtacggggcccgggacccgtccgtcccgtacccgtaccctacccctaccccgtacccaacccgtaccgg

SEQ ID NO: 419165 - DNA, 758 bp, Homo sapiens
  misc_feature: GZ8MTXP02FGLIL.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccggaaggggaacgggccgtgggaggtggactctactactttatttagtaggttggtacggtaccccactatactaacacacgacttccggtagggaaacggggccgtaacttccaaacctacttccctaacgaaagaaaacggtaaacctaaaaccgtttacccgaaaagggtaaaacccaaccttaaagtttacgttaattacctttaaacaaaattacggaaaacttaacccgtagaaggacgggacccggaagggaacccgaaccgggtaccctaagttaggttaactttaacggtgggttagggttacgggggtctttaaacgttttaccgttaccgggtaacccccggtacggggggtacccccgggggtaaaccctcggggtaccctaaccccggtccccgtaccccccctaaccccttacccgaaacccgtaaccccgggg

SEQ ID NO: 419166 - DNA, 625 bp, Homo sapiens
  misc_feature: GZ8MTXP02GVTFF.21.78.H01.1.454.CMB.2.raw
  modified_base (289)..(289): a, c, t, g, unknown or other
  modified_base (303)..(303): a, c, t, g, unknown or other
  modified_base (473)..(473): a, c, t, g, unknown or other
  modified_base (599)..(599): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggtcttgatccagccgtgggggtccctgacgactctcctgtgcagtctcgtgggttcgtcgagtggcgactacntgagcgtgggtccnccgaggctccgagggacggcgtggagtggatctctactttattagtagtggtcgtaacccactactactacacacgtactccggtagacgggtccgtatccacactctacaagaaacactaactaccgaagaccactattacgtatactacaaaatcgaaacttaaccgngagtacggacccgtaaaggacccgtacgggacctaaggttagttaacttacgtgggtacggttggggacttagtttaccgtcggaccccgggttgggggaccccgtacgtcgaccgtacccgtccncccccgtacctcccgaacgtacccgg

SEQ ID NO: 419167 - DNA, 775 bp, Homo sapiens
  misc_feature: GZ8MTXP02HBTXJ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaagctgtccagtgtgaggtgcagttggtggagactggaggaggcttgatccagccgtgggggtcctgagactctctgtgcagtctcgtgggttcgtcaggtggcgactacatgagcgtgggtccgcgaggcctccgaaggggaacgggcctagggaggtggaattcctactaactttaagtttagtaggttggtaccggtaaccaactactaactaacacgaacgtaccgtccggtaggaaacggggtcccgtaattccaaaccctataccctacgaaagtaaaacgaaccaaaacttacccgaaaggaaacctaaacctaagtttagtaattacctttaaacaaaattagaaaactttaaaccaggaacggaacgacccggaaaggaaccgaacgggaccctaagttaagttaaacgtttaacgtacgggttgggttacgggggaaactttaaacggtttttaaaccggtttacccgggaaccccccgggtttcgggggggaaacccccgggggtaaaaccccgttcggggtttaaccccgacccccgggttaccccgtaacccccccctaacccccgtttaccccgaaaaccccccgggg

SEQ ID NO: 419168 - DNA, 751 bp, Homo sapiens
  misc_feature: GZ8MTXP02GILG0.21.78.H01.1.454.CMB.2.raw
tcagtcgtcgctcgcacgaccggtgctcgattagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagcgtgggtccgcaggctccgagggaaggcctggagtggatctacgtactttatttataggtggtacggtaccccactataactacaacaacgacctccggtaggaaacggggtccgaactttccgaacctattcctaccgaaagaaacgaactaaacttaccgaaagggaaaccactaatttacgtaacttaccttaacaaaattaggaaaacttaaacccgtaggaaacgaacggaacccggaaacggaaccgaaccgggaccctaagttaggttaaactttaacgtggttacgggttagggggtactttaaacgttttaaccgttaccgggtaacccccgggttaccggggggaacccccgggggttaaaaccccgtcggggttaccccgtaaccccgggtttaccccctacccccccggtaaacccccttacccccgaaacccggtaaaacccccggggg

SEQ ID NO: 419169 - DNA, 641 bp, Homo sapiens
  misc_feature: GZ8MTXP02IO4HH.21.78.H01.1.454.CMB.2.raw
  modified_base (282)..(282): a, c, t, g, unknown or other
  modified_base (483)..(483): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctctgtgcagtctcgtggttcgtcgagtggcgactacntgagtcgtcgggtccgccgaggcctccggaaggggaaggggacgtggggagtgggaattccgtactactttaatttagtagtgggttacggtaccccacactactacacgacgactccggtagacgggcctattccacatcacagaaacgacaacttccgaagaactactattacgtatactagaaaattcgaaataaccngaacgaggaacccgagaccgacggccaagtgttaactacgtggtacggtcgggtactacgttttaccgtccggaccccgtcggggggaccccggtaaccgttcgggtacccctcccggttaccctacccccgaccccgtacccgacgtaaaccccggg

SEQ ID NO: 419170 - DNA, 683 bp, Homo sapiens
  misc_feature: GZ8MTXP02JTK54.21.78.H01.1.454.CMB.2.raw
  modified_base (398)..(398): a, c, t, g, unknown or other
  modified_base (484)..(484): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgacgcgtcgggtccgccgacggccccgaggggaacgggccgtggaggtggacgtctctaacttatttagtagtggtacggtacaaccgtatactacacacgacgtaccgnggaacgggcggtacttacaccactctaccgaagaaagaacctaacttccgaaggaaacccagtatttacgtattactacttaaaanagtaaactaaccgtaggagtaacggaccgaaggaaccacggacccgtaagttcgtacgtttaaacgtgggttaacggggttcggggtacttagtttacccgtaaaccgggccccggttacggggggacccgggtaccccgtagttaacccgaacccgttccccgtaccccaccctcccggtaacccgacggtacccccg

SEQ ID NO: 419171 - DNA, 601 bp, Homo sapiens
  misc_feature: GZ8MTXP02GHYOE.21.78.H01.1.454.CMB.2.raw
  modified_base (298)..(298): a, c, t, g, unknown or other
  modified_base (446)..(446): a, c, t, g, unknown or other
tcagtcgtcgctcgcacgaccggtgctcgatttagtgtgagtagtttgggtttgggggggaggaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccncaggctccgagggaaggcctggagtggatctcactttatttatagtggtggtacccacatactacacacgactccgtagaacgggccgtattcactatctacagaagacaacttaccgaaggaaacacagtttacgtaattaccttanaaaacttagaaacttaaaccctagaacgaggaccgaacggacacggcctaattgtaattactggtgtggggtctactttacgtcgtacccgtacgggggcccgggtaaccgtggtccaacccgtcctcccccgaccctcccgaccgtaacccggg

SEQ ID NO: 419172 - DNA, 741 bp, Homo sapiens
  misc_feature: GZ8MTXP02F80G2.21.78.H01.1.454.CMB.2.raw
  modified_base (712)..(712): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtctgggttttccttgttgctatttacaaaggtgtccagtgtgaggtgctaggttgggtggagacgtggaggaggtcttgactccgacggccgggttcgggggtccctggaacgtccttcctccgtgtcgctagttctcggttcgggttcgtcgaggtggacgtactacagtggacgtccggtcggggtaccccgaccggacggtccgtaccgggaagggggaacggggtccgtagggacgtgggacttcgtacttatttatttaacgtaggttggtcggtaacccctactactaacctacacgtacgtaccgtccggtaggaaccgggtcgtacttacccaactactctaacaaagtaaacgacctaaacttacccgaaagtaactactaattagtacttacttaacgaaaattacgtaaactaaccgtggaaacgacggacggaacgtacgaccggtactaagttacgttaacttcgtaggttcgggtacggtacttacgtttaccgtccggaaccccggggtcgggggacccggtacccgtggtacccgaccccgttccccncccccgtacctacccgaccggtaacccgg

SEQ ID NO: 419173 - DNA, 742 bp, Homo sapiens
  misc_feature: GZ8MTXP02IKM5S.21.78.H01.1.454.CMB.2.raw
  modified_base (241)..(241): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattcaaaggtgtccagtgtgaggtgcagttggtggagacgtggaggaggcttgatccgagccgtgggggtcctganactctctgtgcagtctcgtgggttcgtcaggtggcgtaactacatcgaagccgtcgggtcccgccgaagggcctaccggaaggggaacgggcccgtaggaggtagggacttccgttctaactttagtttaagtaggttgggtacgttaacccccataacttaactaaccaacgtaacggaccttacccgggttaggaaaacggggtccccgtaaatttcccgaacctaacgttacctaccgaaaggaaaaccgtaaactaaaactttaccgaaacgggtaaaacctaacgtaacgttttagtaaacttaccttaacgaaaattacgtaaaactaaaccgtagaacggtacggaccgacgacgacgactatgttaactagtgtaggtacgggtactacgtttaacgtaccggtaccccggtacgggggtacccggtaaacccgtcggtacccctaccggtcccctacccccgtacccgttaccccgaaccggtaaccccggg

SEQ ID NO: 419174 - DNA, 704 bp, Homo sapiens
  misc_feature: GZ8MTXP02GVQOD.21.78.H01.1.454.CMB.2.raw
  modified_base (293)..(293): a, c, t, g, unknown or other
  modified_base (385)..(385): a, c, t, g, unknown or other
  modified_base (553)..(553): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggtcttgactccaggccgtcggggggtcctgagactctctgtgcagtctcgtgggttcgtcgagtggcgactaacngtgagcgtcgggtccgccgtaggcctaccggaggggaacggtccgtaggaggtggatctctacttatttagtaggtggttacggaccccaanactaactaacacacgtactccgggtacggaacgggtccgaacttccaacctagttccacgaaagaaacgaactaaacttacccgaagaaacctacgtattagtaacttccttaaataaatacgaaactaaccgtagaacgacggaccggaaaggacgtacccgggtanaattacggtaatttacgtggttggggtaacggggttctaaacggttttccgtaccgggtaccccggggtggggggtaacccccggaaccgtcggttacccgaaccggtttcccccaccccctaccccggcccgtaacccggtaccccgggg

SEQ ID NO: 419175 - DNA, 571 bp, Homo sapiens
  misc_feature: GZ8MTXP02I92WZ.21.78.H01.1.454.CMB.2.raw
  modified_base (400)..(400): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctggggtccgccaggctccgagggaacgggcctggagtggatctcactttatttatagtggtgtacccacatactacacagactcgtgaacgggccgattcacatctacanaagacaattaccagaacactattgtatcttacaaagtgaaataacctagagagaccgaggacacggcctatgtatactcgtggtcggggctacgtttactacggacccctcgggggacccgggtaccgtcggtcccaccggtccctccccgaccctaccgaccgaaccggg

SEQ ID NO: 419176 - DNA, 709 bp, Homo sapiens
  misc_feature: GZ8MTXP02GVGUQ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcgagtggcgactacatgagcgtcgggtccgccgaggctcggagggaacggccgtggagtggatctctacttattatagtggtacggtacccacatactacacacgtactccggtagaacggggcctattaccacctactactacgaagaaagtaaccaaacgttcccgaaagaacctactaattgttaacttacttaacgtaaaatacgtaaaacttacccgtaaggaacggacggtaaccggaacggtaaccgaaccggggtacctaagtacggtttaacgttaaccgttcgggtaggtttcgggggaactttacggttttaccgttaccgggtacccccggtaggggggacccccggggtaacccgtaacggtccccgtaaacccggtccccgtaccccccgtaccccgtaccccgtaaacccggaaccccggg

SEQ ID NO: 419177 - DNA, 568 bp, Homo sapiens
  misc_feature: GZ8MTXP02FHSD1.21.78.H01.1.454.CMB.2.raw
  modified_base (342)..(342): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctattttcaaaaggtgtccagtgtgaggtgcagttggtggagactggagaggcttgatccagcctggggggtccctgagactctcctatgcagtctctgggttcgtcagtggcgactacatgagctgggtccgccaggctccgagggaagggcctggagtggatctcacttatttanagtggtggtaccccacatactacacagactccgtgaaagggccgattcaccatctcagaagacaattccagaacacattgtatacttcaaatgaaataacctgagagaccgaggacacggccatgtaattactgtgtggggctaactttacgtacgtaccccgtggggcccggggtaaacccgtggtaccacccggtcctcccccaccctcccaaccgaacccggg

SEQ ID NO: 419178 - DNA, 575 bp, Homo sapiens
  misc_feature: GZ8MTXP02HRN9L.21.78.H01.1.454.CMB.2.raw
  modified_base (376)..(376): a, c, t, g, unknown or other
  modified_base (398)..(398): a, c, t, g, unknown or other
  modified_base (401)..(401): a, c, t, g, unknown or other
  modified_base (403)..(403): a, c, t, g, unknown or other
  modified_base (405)..(405): a, c, t, g, unknown or other
  modified_base (418)..(418): a, c, t, g, unknown or other
  modified_base (421)..(421): a, c, t, g, unknown or other
  modified_base (427)..(427): a, c, t, g, unknown or other
  modified_base (432)..(432): a, c, t, g, unknown or other
  modified_base (443)..(443): a, c, t, g, unknown or other
  modified_base (459)..(459): a, c, t, g, unknown or other
  modified_base (465)..(465): a, c, t, g, unknown or other
  modified_base (470)..(470): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctctgggttcgtcgagtggcgactacatgagtcgtggggtccgccgaggcctccgaggggaacggccgtggagtggatctcgactttatttatagtggtgtaccccatatactacanagactcgtgaaggcacttcacntcnananacaatcagacacnttnatctanaaatnaataactgagngacgagacacgcagtntatacngtggngggtactacgttttaacgcgtaccccggtacgggggacccggtaacccgttggacccgacccgttacccgacccccgtaccccgtcccgaaccgtaaaccccggg

SEQ ID NO: 419179 - DNA, 590 bp, Homo sapiens
  misc_feature: GZ8MTXP02FHQT4.21.78.H01.1.454.CMB.2.raw
  modified_base (402)..(402): a, c, t, g, unknown or other
  modified_base (407)..(407): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgagtggcgactacatgagcgtgggtcccgcgacggctccgaggggaaggccgtggagtggatcgtcacgtttatttagtagtggtgtaccccatatactacacagactccgtagaacggcgatcacatctanagaanacaatccaagaacacaattgtatacttacaaatgaaataacctgagacgaccgaagacacggcatagtattacgtgtggtgggactacgtttacgtaccgtacccggtacgggggaccccgggtaacccgtggtaccccgaacccggttcccaccccctacccgtcccgacccgaaacccggg

SEQ ID NO: 419180 - DNA, 680 bp, Homo sapiens
  misc_feature: GZ8MTXP02ISYQL.21.78.H01.1.454.CMB.2.raw
  modified_base (505)..(505): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttcaaaaggtgtccagtgtgaggtgcaggttggtggagacgtgggaggaggtcttgatccgaggccgtcggggggtccctgacgtactctcctgtgctagtctcgttgggttcgtcgaggtcggcgactacagtgagtcgtcgggtcccgccgaggcccgtaccggaaggggacggccgtgggacgtggacttctactatttattagtaggtggtacgtacccactatactaacacaacgaccgtccggtagaacggggtcctacgttaccaccattccacaaaggaaactaacaattacccgaaagaacctagtaatttcgtaacttaccttaanaaaattacggaaaacttacgagaacggacggacgaaacggacacggctagttgtaaactgaggttcggtggtactacgtttaccgtccggaaccccggggtcgggggtaaccccggtacccgtcggtcccacccgttcccccgacccctaccccgtacccgacccgaaccccggg

SEQ ID NO: 419181 - DNA, 680 bp, Homo sapiens
  misc_feature: GZ8MTXP02FOELN.21.78.H01.1.454.CMB.2.raw
tcagtcgtcgctcgcacgaccggtgctcgatttagtgtgagtagtttgggtttgggggggagaggagcccagcactgggattccgaggtgtttccattcagtgatcagcactgaacacagaggactcaccatggagttttggctgagcttgggttttccttgttgctatttcaaaaggtgtccagtgtgaggtgcagttggtggagacgtgggaggaggcttgatccagccgtgggggtccctgagactctcctgtgcagtctcgtgggttcgtcaggtggcgactacatgagcgtcgggtcccgccgaggccgtaccggaggggaacggccgtggagtggatctactactttattagtaggtggtacgtaccactataactacacacgtccgtccgtaggaacgggcctattaccaccatcctacaagaaacgaactaaacttacccgaaaggaaaccaacgttatttacgtaacttacttaaactaaaataacgtaaaactaaccgtaggaacgaagacccgaaggaccacggacctatagttacttacgtggtaggtgggtacttaacgtttacgttccggtaaccccgggtcgggggacccccgggtaaacccggttcggtaccccgtaccccggtaccccctacccccgtaacccccgcccgtaaaacccccggg

SEQ ID NO: 419182 - DNA, 632 bp, Homo sapiens
  misc_feature: GZ8MTXP02G0EUP.21.78.H01.1.454.CMB.2.raw
  modified_base (421)..(421): a, c, t, g, unknown or other
  modified_base (443)..(443): a, c, t, g, unknown or other
  modified_base (460)..(460): a, c, t, g, unknown or other
  modified_base (507)..(507): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttacaaaggtgtccagtgtgaggtgctagttggtggagacgtgggaggaggcttgatccgagccgtcgggggtccctgacgactctcctgtgcagtctcgtgggttcgtcagtggcgactacatgagcgtgggtccacgaggcctccgaaggggacggccgtaggagtggatcgtctaactttattatagtggtcgtaaccccactatactacactagactccggtagaacgggctattccacatctacagaanactaatccaagtaacataattntatacttacaaagttanaaactaaccgtgagacgcgaacgaccgacggacctagtgtattacgnggttacggtcggggtacttacgtttaacgtccggaccccgggttcgggggtacccgggtaaacccgtcgggtacccgtaacccggtcccctacccccgtaccccgtacccgaacccgaaacccgg

SEQ ID NO: 419183 - DNA, 689 bp, Homo sapiens
  misc_feature: GZ8MTXP02GQNRQ.21.78.H01.1.454.CMB.2.raw
  modified_base (307)..(307): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagctgggttttccttgttgctattcaaaggtgtccagtgtgaggtgctagttggtggagacgtggaggaggcttgatccagccgtcgggggtcctgagactctcctgtgctagtctcgttgggttacgtcgaggtggcgactacatgacgcgtcgggtccnccgaggcctacggaggggacggccgtggagtggatctactacgtttatttagtaggtggttacgtaccccatactactaacacgacgtaccgtccggtagaacgggccgtaattccaacctatcctaacgaaagaaacgaactaaacttacccgaaaggaaacctacgtatttacgtaacttacttaactaaaagtcgtaaaacctaccgtagaacgaacgggacccggaacggtaaccaccgggctagttacgttaaattcgtggtgggtacggtacttacgttttacgacccggttacccgggcgggggtaaccccgggtaccgtcggtacccctaccggttacccccgtaccccaccccgttaccaaccgggtacccgg

SEQ ID NO: 419184 - DNA, 659 bp, Homo sapiens
  misc_feature: GZ8MTXP02HART5.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctgagactctcctgtgcagtctcgtgggttcgtcagtggcgactacatgagcgtgggtcccgccgaggctccgaggggaacggcctggagtggatctactactttatttataggtggtacggtaccccaactagtaactacacacgacctccggtagaaacggggccattccactatcactaagaaacgaacaacgttaccgaaaggtaaaccactaagttacgttaacttacttaacaaaagtacgtaaactaaccgtgaagacggaccgaaggacaccggccaagtcgtaattacgtggtggtaggggtcttaacgtttaccgtaccgtacccccgggtacgggggacccgggtaacccgtcgggtacccgtaccccgtccccgtacccccaacccgtcccgaaccggtaaccccgg

SEQ ID NO: 419185 - DNA, 674 bp, Homo sapiens
  misc_feature: GZ8MTXP02JE406.21.78.H01.1.454.CMB.2.raw
  modified_base (474)..(474): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagacgtggaggaggcttgatccagccgtgggggtcctgagactctcctgtgcagtctcgtgggttcgtcagtggcgactacatgagctggggtccgccaggctccaggggaagggcctggacgtgggatctcgactttagtttactagtggtggaacccactaatactacacacgactcggtagaacgggccgattcacatctcaaggtaacacaattcccaaggaaaccactaattagtatcttaacaaaatgaaaactttaaaccccgngaaacggacgtacccggaaagggaacccacggggtaccctaagtaccggttaattaacctggttacggggtggggacctttaaatttaccgtcgggtaaacccccggtggggggtacccccggggtaaacctcgggggtacccctaaccccgggttccacccccccgtaaccccttacccggaaaccctaaacccggggg

SEQ ID NO: 419186 - DNA, 612 bp, Homo sapiens
  misc_feature: GZ8MTXP02FUVI8.21.78.H01.1.454.CMB.2.raw
  modified_base (357)..(357): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgcgggctccgaggggaggccgtggagtggatctctacttagtttatgtggtggtaccanactactacacagacctccgtggaacgggccgattccactatctacagaagacaattaccaaggaaccactatttacgtaattaccttacaaaatgtaaaactaacctaggaagaccgaccggaggaacacggaccagtcgttaattacgtgtggtacgggactatttacgtcggaccccggtcgggggacccggtaacccgttcggcccgtaaccgtcccctcccccgtaccctcccaaccggtaacggtccccg

SEQ ID NO: 419187 - DNA, 689 bp, Homo sapiens
  misc_feature: GZ8MTXP02GW3YX.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttagctgagctgggttttccttgttgctatttcaaaaggtgtccagtgtgaggtgcagttggtggagacgtggaggaggcttgatccagccgtgggggtccctgagactctctgtgcagtctcgtgggttacgtcgagtggcgaactacagtgagcgtgggtccgccaggcctccgaggggaacggccgtaggagtggatctcactttattagtagtggtagtaccccacatactacacagacgtccgtagaacgggaccgtattcgaacctatcctacgaaagaaacgaactaaattacccgaaggaaactacgaatttacgtaattaccttaactaaaagtacgtaaaactaaacccgtaggaagacggaacccggaaggaacccacgggacctaaagttcgttaaacgttaccgtaggttggtacggggtacttaacgtttaccgtacggtacccccgggtacgggggtaacccgggtaaaccccgtcggtttacccgaccccggttccctaccccccgtaccccgtacccgaaacccggaaccccggg

SEQ ID NO: 419188 - DNA, 662 bp, Homo sapiens
  misc_feature: GZ8MTXP02GY03Z.21.78.H01.1.454.CMB.2.raw
  modified_base (521)..(521): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgagactctcctgtgcagtctcgtgggttcgtcagtggcgactacatgagtcgtcgggtcccgccgacggcctaccggaggggaacggccgtaggagtggatctctactttatttagtgtggtcggtacccactatacacacagactcgagaacgggccatccacatcacaagacgaacaatccaagaacactagttgacttactaacaaaatgtaaaacttaaccgtagaagacggaaccgaagggaaccacggggtacctaagttacgttaactttagnggtttaggggtacggggtcttaaacggttttccggtaccgggtaaccccccgggttggggggaacccccgggtaacccgtccggttaccaacccccgttccccaccccccgtacccctaccccgaaccggtaacccccggg

SEQ ID NO: 419189 - DNA, 916 bp, Homo sapiens
  misc_feature: GZ8MTXP02JY1Q0.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccagccgtgggggtccctgagactctctgtgcagtctcgtgggttcgtcaggtggcgaactacatgagcgtcggggtcccgccgagggcctaccggaaggggaacggggtcccgtggggaggtgggtacttcctacgtaactttattttaagtaggtggggttacggtaccccctaacgtattaacctaaccaacgtaacggtaaccgttcccggggttaagggaaaccgggggtacccggttaactttaacccaaccctaaacttccctaaaccgaaaggtaaaacggaaccctaaacgtttaccccgaaaaggggaaacccaaacgttaacgttttaacgttaaacgtttacccgttttaaacaaaaaacgtttaacgggtaaaactttaaaaccccgtagggtaaaaccggtaccgggtaacccggggaaacggtaaaccccggggaacccgggtaaccccgtaagtttaccggtttaaacgtttaccgtttaggggttacggggtttaacgggggttaccttaaaaccggtttttaccggttacccggttaaacccccccgggggttcgggggggttaacccccgggtttaaccccggtaacccggggttaaccccgttaccccccggttaccccgttaacccccccgaacccccgtttacccccgaaaaccccggttaaacccccgggg

SEQ ID NO: 419190 - DNA, 571 bp, Homo sapiens
  misc_feature: GZ8MTXP02GN7SA.21.78.H01.1.454.CMB.2.raw
  modified_base (359)..(359): a, c, t, g, unknown or other
  modified_base (392)..(392): a, c, t, g, unknown or other
  modified_base (396)..(396): a, c, t, g, unknown or other
  modified_base (398)..(398): a, c, t, g, unknown or other
  modified_base (407)..(407): a, c, t, g, unknown or other
  modified_base (409)..(409): a, c, t, g, unknown or other
  modified_base (416)..(416): a, c, t, g, unknown or other
  modified_base (429)..(429): a, c, t, g, unknown or other
  modified_base (462)..(462): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtggttcgtcagtggcgactacagtgagcgtcgggtccgcgaggctccgagggaacggcctggagtggatctctactttattagtagtggtagtacccanatacacacagactcgagaacggcatcacatcanagananatcagacantnatctaanaaatagaaatacngagacgacgaacgacacgtacatagtaatacgnggtacggtacggtacttacgttacgtaccggacccggtacgggggacccggtaaccgtcggtacccgtacccgtacccctacccccgtacccacccgaacccggaaccg

SEQ ID NO: 419191 - DNA, 743 bp, Homo sapiens
  misc_feature: GZ8MTXP02HN31G.21.78.H01.1.454.CMB.2.raw
  modified_base (333)..(333): a, c, t, g, unknown or other
  modified_base (409)..(409): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcagttggtggagacgtgggaggaggtcttgactccgaggtccggttcggggggtccctggacgtacttcctcctggtgctagtctcgttgggttcgtcgtaggtcggacgtaactacagtagagtcgtcgggtccnccgaggcctaccggaggggaacggccgtggagtggactctacctatttattagtagtggtcgtacccacatactanacacgactccggtaggaacgggcctattaccaccatccgactaaagaacgaactaaacgttacccgaagaaacctacgtattagtacttacttaaacaaaagtacgtaaaacttaaccgttggaaacggaccggaaccggaagaacccgaaccgggtacctaaagttacgttaacgtttaagcggtttagggtacggggttcttaaacgttttaccggtcccggtaccccggggtacggggggtaacccccgggtacccgtaacgggtaccccgtaccccgttacccccgacccccccgtaccccgtaacccgtaaaccccggtaaccccgggg

SEQ ID NO: 419192 - DNA, 759 bp, Homo sapiens
  misc_feature: GZ8MTXP02H8J5W.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggagggaggcttgatccgaggtccgtcgggggtccctgacgactctcctgtgcagtctcgtgggttcgtcgaggtggcgactacagtgagtcgtcggggtcccgccgaggcctaccggaaggggaacgggcccgtggaggtggacttcgtactactttagtttagtaggtggtcggtaacccactactactacacacgactccggtaggaacgggccgtataccaacctatcctacaagaaacgtaactaacgttaaccgaaggtaaactaacgtaatttagtaactttaccttaactaaaaagtacgtaaaacttaaccgttaaggaaacggaacggacccggaacgggaaaccgaccggggtaacctaaacggtttagttaaacgtttaccggttagggttacgggttacgggggttactttaacgttttaaaccggttcccgggtaaccccggggtcgggggttaacccccggggtaaacccgttccggtacccgtaccccgtaccccgtacccccgacccccgtaccgaaaccccggtaaccccgg

SEQ ID NO: 419193 - DNA, 795 bp, Homo sapiens
  misc_feature: GZ8MTXP02GB8NT.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcagtctcgtggttcgtcagtggcgactacatgagcgtgggtccgccgaggcctaccgaaggggaacggcctggaagtggaatctactaacgtttatttaagtacggtggtacggttaccccactaataactaacaacgaacgtacgtccggtaggaaacggggccgtaacttaccaacctatcctaacgaaagaaaacggaactaaacttacccgaaagggtaaaacccaactaaacttttaaggtaaactttaacccgtttaaaactaaaaacgttaaacgtaaaaccgttaaaccggtaggaaacgggtaaccgggaacccggaaacggaaccggaaccggtacctaagtttaacgttaaacgtttaacggttcgggttacggggttacggggtaacctttaaacggttttaaaccggttacccgggtaacccccggggtaccggggggtaaccccggggtaaacccgttccggttacccgtaaccccggttacccccgtaccccccgtaacccgtaaccccgtaaacccggaacccggg

SEQ ID NO: 419194 - DNA, 773 bp, Homo sapiens
  misc_feature: GZ8MTXP02GGUUN.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcgaggtcggcgactacatgagtcgtcgggtccgccgaggcctccggaaggggaacggccgtagggagtgggtactcctacgtacttttagtttaagtaggttggttacggtaaccccctaacgtaacttaactaaaccaacctaacggaccgttcccggggtaggaaacggggtacccgtactttacccaaacctacgtcctaaccgaaagaaacgaaacctaaaactttcccgaaagggaaaccctacgttaatttaacgttattaccttaaacaaaagttacgtaaaacttaaaacccgtggaaaggaccgggaccgaaacggggaccgacggtacctaagttacgtaatttaacgtgggttaaggtcggggtactttaacgtttaccgtttaccgggacccccgggtacgggggacccccggggtaacctcggggttaccccctacccggttaccccctcccccggaacccccttaccccggaacccgtaacccccgggg

SEQ ID NO: 419195 - DNA, 788 bp, Homo sapiens
  misc_feature: GZ8MTXP02H0ZDS.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgagccgtgggggtccctgagactctcctgtgcagtctcgttgggttcgtcgaggtcggcgactacagtggacgtccggtgggtccccgaccgacgggccgtaccggaaggggaacggggtcccgtagggaggtggtacttccgttacgttaacttttaagtttaacgttagggttagggtacggttaacccccaacgtaacttaacctaacctaacgaacggtaacccgttccgggtaacgggaaacggggtacccgtaactttacccgaaccctaatttcccgaacgtaaagaaacgtaaacctaacttaacccgaaagggtaaaacctaccgttaagtttacgtaacttacttaaacctaaaaagttcgtaaaacttaaaccgtaggaacgtaccgggaccgaaacggaccaccggtactaagtagttaactacgtggtaggtcgggtacttacgtttaccgaccggtacccccgggtacgggggtaccccggaaccgttccgggtacccctaccccgttcccccgaccccctaccccgtaccgaaacccggtaccccgg

SEQ ID NO: 419196 - DNA, 655 bp, Homo sapiens
  misc_feature: GZ8MTXP02I1RGJ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgctagttggtggagacgtggaggaggcttgatccagccgtgggggtccctgagactctcctgtgcagtctcgtgggttcgtcagtggcgactacagtgagcgtcgggtcccgccgaggcctccggaggggacggcctgggagtggatcgtctactttatttagtagtggtcgtaaccccacgtataacctacaacacgacctccggtacggaaacgggggccctacttaccgacccattccacctaaaggaaacgaacgaaacttacccgaaggaaacctactaagttatattacttactaaatacgaaactaacgtagaggacgaccggaacggacacggacctatgttatacgtgtcggtgggtactacgtttacgtccgtacccgggtcgggggtacccgggtaacccgtggtacccgacccgttcccgacccccgtaccccgtaccgaacccgtaacccgg

SEQ ID NO: 419197 - DNA, 637 bp, Homo sapiens
  misc_feature: GZ8MTXP02GBQP6.21.78.H01.1.454.CMB.2.raw
  modified_base (299)..(299): a, c, t, g, unknown or other
  modified_base (391)..(391): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctggggtccncaggctccgagggaaggcctggagtggatctcacttagtttatagtggtgtaccccacatactacacagactccgtgaaggccatcacatcncagaagacaattccaagaacacattagtatacttacaaaatgaaactaaacctgaagacgaccgaaggaccgacggccaagttagtatttacgtgtacggtgggggtctaaacgttttaccgttccgtaaacccccgggttcgggggtaccccgggggtaaaacccccgttcggggttacccctaccccgggttacccccttaccccccaacccccgttacccccaacccggtaaaacccccgggg

SEQ ID NO: 419198 - DNA, 743 bp, Homo sapiens
  misc_feature: GZ8MTXP02IVL1V.21.78.H01.1.454.CMB.2.raw
  modified_base (437)..(437): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccggtgggggtcctgacgactctcctgtgctagtctcgtgggttctcgagtcggcgactacagtgagcgtcgggtccaccgaggtcctaccggaagggacggccgtaggagtcggacttcgtactaacgtttatttaagtaggtggttacggtaaccccacgtactactacgactacggaccgtcgtaggaacgggcctagttccacgtntaccgtagaagaaacgtaacctaacgttaccgaaggtaaaccacgttaagtttcgtaacctttacgtaaccaaaagttcgtaaaaccgttaacccgtaggaacgtaaccgggaaccccgtaaaggggaaccacccggggtacctaaagtttacgggtaaactttaccggtaggttacgggtacgggtacttaccgtttacgtaaccggtccccggggtacgggggaaccccggttaaccgtccgggttacctaaccccgggttccctacccccctaaccggttaccccaaaccggtaaaccccggg

SEQ ID NO: 419199 - DNA, 624 bp, Homo sapiens
  misc_feature: GZ8MTXP02IDU4U.21.78.H01.1.454.CMB.2.raw
  modified_base (302)..(302): a, c, t, g, unknown or other
  modified_base (506)..(506): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttacaaaaggtgtccagtgtgaggtgcagttggtggagacgtggaggaggcttgatccagccgtcgggggtccagagactctcctgtgcagtctcgttgggttctcagtggcgactacatgagcgtggggtccnccgaggcctaccggaggggaacggggccctgggagttgggattcgtctactttatttatagtggtcgtaccccatatactacacagactccgtagaaggccgattccacatcacagaagaactaattcccaagaaccactattagtacttcttaacaaaatacgtaaactaacctgaagacgaccgaggaacgacggactagtnttatacgtgtacggtggggctaatttaccgtcggtaccccggtcgggggtaccccggtaacccgtcggtacccgtaacccgtcccctacccccgaccctacccgaacccgaacccggg

SEQ ID NO: 419200 - DNA, 612 bp, Homo sapiens
  misc_feature: GZ8MTXP02FRT7D.21.78.H01.1.454.CMB.2.raw
  modified_base (301)..(301): a, c, t, g, unknown or other
  modified_base (432)..(432): a, c, t, g, unknown or other
  modified_base (467)..(467): a, c, t, g, unknown or other
  modified_base (485)..(485): a, c, t, g, unknown or other
  modified_base (496)..(496): a, c, t, g, unknown or other
  modified_base (504)..(504): a, c, t, g, unknown or other
  modified_base (515)..(515): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccgagcgtcgggggtcctgagactctcctgtgcagtctcgtgggttcgtcgaggtggcgactacatgagcgtcgggtccnccgaggcctccgagggacggcgtggagtggatctactactttattagtagtggtcgtaaccccgatataactaacactaacgacctccggtaggaacgggccgtaatccgaaccagtctaacgaaagaaanaactaaactccgaaagaaccatagttctatactanaaaatagaaatacgtganacgacgacganccgactangttatactggnggtaggcttacgtttcgtccgacccgggtggggaccccggttaaacgtggtcccgaacccgtccctaccccgaacccctcctaaacccggaacccgg

SEQ ID NO: 419201 - DNA, 692 bp, Homo sapiens
  misc_feature: GZ8MTXP02GT1HP.21.78.H01.1.454.CMB.2.raw
  modified_base (252)..(252): a, c, t, g, unknown or other
  modified_base (416)..(416): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctctgtgcngtctcgtgggttcgtcgaggtggcgactacatgagcgtcgggtccgccgaggcctacccggagggggaacggccgtggagtggactctactactttattagtagtggtagtacccacatactacacagactccggtagaacggccattaccacatcacaagaanactaatccgaaagacacagtttacgtattacttaactaaatagtaaaactaccgtagaaacgacggaacccgaaggacccgaacggtaccaagtttagttaaacgttacgtacgggttagggttacggggtactttaaccgttttaacggttaccgggtaacccccggtcgggggggtaacccccgggtaaaccccgttggggtaacccccgtaaccccggtttcccccgaccccccccgtaacccgttacccccgaaacccggtaaacccccggg

SEQ ID NO: 419202 - DNA, 553 bp, Homo sapiens
  misc_feature: GZ8MTXP02JTN6O.21.78.H01.1.454.CMB.2.raw
  modified_base (478)..(478): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccgaggggaagggcctgggagtggatcgtctacttatttatagtggtggtaccccacatactacacagactccgtagaagggcccgtattcaccatctacagaagacaatccaaggaacacattagtatctacaaatgaaataacctgaagacgcgagacacggcatgtatacgngtgtgggctagtttactcgacccgtcgggggaccggaccgtggccaccggtcctccccaccctccaccgtaccgg

SEQ ID NO: 419203 - DNA, 631 bp, Homo sapiens
  misc_feature: GZ8MTXP02GTEQC.21.78.H01.1.454.CMB.2.raw
  modified_base (299)..(299): a, c, t, g, unknown or other
  modified_base (403)..(403): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccnccgaggcctaccgaggggaacggtcctaggagtggatctctacttatttatagtggtcgtaacccacatactacacgacgactccgtagaacggccgattcacntactcagaagactaatccaagaacactattagtactacttactaaatcgtaaataacctagacacgaccgaggaccgacggaccagtgttattacgtagtaggtacggggtactacgtttacgtaccggtaccccggttacgggggaccccggggtaaccgttcgggtaccccgtacccggtaccccgtaccccctaccccgttaccccgaaacccggtaaccccggg

SEQ ID NO: 419204 - DNA, 824 bp, Homo sapiens
  misc_feature: GZ8MTXP02JJK9V.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggcttgatccgagccgtgggggtccctgacgactctcctgtgctagtctcgtggttcgtcgaggtcggcactacagtggacgtcgtcggggtccgccgaggcctccggaggggacggccgtgggagtggacttcctacgtaacttttagtttagtaggtcggtacggtaaccccacgtaactacctaaccacctaacggtaccgttccgggtacgggaaaccgggtacccggttaactttaccgaacccgtaattcccgtaaacgaaacggtaaaaccgtaaaccgttaaacgtttaacccgaaacgggtaaaaccctaccggttaaagttttacggttaaccttaaccgttaaactaaaacgttacggttaaaaacttaacccgtaggaaacggaaccgggtaccccggaaggaacccgaaccggaccgttaattacgggttaactttaccggtcggttaggggttacggggtacctttaacggtttaacccggtaccggtaccccccggggtacgggggtcccccgggtaaaccgttccgggtacccctaaccccgggttccccctaccccccgtaccccgttaccccggaaccccggtaaccccgg

SEQ ID NO: 419205 - DNA, 768 bp, Homo sapiens
  misc_feature: GZ8MTXP02F5GJQ.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcaggtggcgactacatgagcgtgggtcccgaccgaggcctccggaaggggaacgggccgtggagtggactcgtctactttatttagtagtggtcgaccctacactaactacacacgacttccggagaacggggccgtacttccgaaacctattccgaacgaagaaaacgtacctaaacttccgaaaggaaacccacgttattacgtattaccttaataaaaattgaaaacttaaaccgttgggaacgtaaccggaccggaaacgacgaaccgggtacccaagtttcggttaactttaggcggtttggggttaccgggggtacttaaacgttttttccccggtaaacccgggtaccccccgggggtttacgggggggtaacccccccggggttaaaacccggttcggggttaacccccgtaaaccccccggtttcccccgtaaaccccccccggtacccccgtttacccccggaaaacccggttaaaccccccggggg

SEQ ID NO: 419206 - DNA, 718 bp, Homo sapiens
  misc_feature: GZ8MTXP02JVU1H.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtggttcgtcaggtggcgactacatgaggcgtcggggtcccgccgagggcctccggaggggaacggggcctagggagtggatctactactttatttataggtggtcggtaccccactatactacacacgactccggtaggaacggggtcctacgttcaccctatacctacgaaagaaagtaacctaaacttacccgaaacgggtaaacctaacgtaacttttaacgggtaactttacctttaaacctaaaaagttcgtaaaaacgttaccccgtagggaaacgtacgggaacccggaaaggacccggaacggaccctattacgttattaccgtggtacggtggggtactacgtttaccgtacggtaccccggtcgggggtaccccggggtaaacccgtccgggttacccaccccgttccctacccccgacccccgtacccgaacccggtaacccgg

SEQ ID NO: 419207 - DNA, 725 bp, Homo sapiens
  misc_feature: GZ8MTXP02G6F0K.21.78.H01.1.454.CMB.2.raw
  modified_base (291)..(291): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtgggaggaggcttgatccgagccggtggggggtccctgagactctcctgtgcagttctcgtgggttcgtctaggtggcgtactacngtgagtccgtcgggtacccgccgacggcctaccggaggggaacggccgtagggaggtggactcctactactttatttagtaggtaggtcgtacccctatataactacacacgactccggtaggaacgggtcctagttccaactatctacgaagaaacgaactaaacgttacccgaaaggaaacctacgtaatttacgttaacttaccttaactaaaattacgtaaaactaaaccgttaggaacggaccggaaccggaacggaccgtaaccggaccgttaagttacgttaacgttaaccgttagggttgggtacggggttcttaacggtttaacggttcccggtaaccccggggtacgggggtacccccgggtaaccggtccggtaccgtaccccggttccctacccccgtacccaccccgtacgaaccccgggg

SEQ ID NO: 419208 - DNA, 626 bp, Homo sapiens
  misc_feature: GZ8MTXP02HF2MG.21.78.H01.1.454.CMB.2.raw
  modified_base (300)..(300): a, c, t, g, unknown or other
  modified_base (446)..(446): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgcttatttcaaaaggtgtccagtgtgaggtgcagttggtggagactgggaggaggcttgatccagccgtgggggtccctgagactctcctgtgcagtctcgtgggttcgtcagtggcgactacatgagcgtgggtccnccaggcctccgaggggacggcctaggagtggatcgtcactttattatagtggtgtaccccatatacactacagacctccggtagaacggccgtattcgacatctacagaagacaagttccaagtaaccagtatagtactacttaanaaatataaactacgtagagacggacgaacggaaccgacggacctagtacgtattacgtggttacggtacgggtacttacgtttaccggtaccggtaccccgggtacgggggtaccccggtaacccgtcgtacccgtaccccgtccccgtaccccctacccgtaccccgaacgtaacccgg

SEQ ID NO: 419209 - DNA, 692 bp, Homo sapiens
  misc_feature: GZ8MTXP02JPBLT.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccgccaggctccgagggaacggcctggagtggatcgtcactttatttatagtggtacggtaccccacgtatactacacgacgactccggtagaacgggccagttaccaccgatcctacagaaacgactaaattcccgaaggaaacacgactttagtacttacttaccaaaagtcgtaaaacttaacctggaacgacggacccggaaggaaccgaaccgggcctaagtagttaatttaccgtggttacggggtcgggggtaccttaacgttttaccggttacggtaacccccgggttcggggggtaacccccgggtaaacccgttcggggacccgtaacccccggttccccgtaaccccccgtacccccgttaccccgaaccggtaaacccccgggg
